(12) United States Patent
Minshull et al.

(10) Patent No.: US 10,435,696 B2
(45) Date of Patent: Oct. 8, 2019

(54) DNA VECTORS, TRANSPOSONS AND TRANSPOSASES FOR EUKARYOTIC GENOME MODIFICATION

(71) Applicant: DNA2.0, INC., Newark, CA (US)

(72) Inventors: Jeremy Minshull, Los Altos, CA (US); Maggie Lee, San Jose, CA (US)

(73) Assignee: DNA2.0, INC., Newark, CA (US)

( * ) Notice: Subject to any disclaimer, the term of this patent is extended or adjusted under 35 U.S.C. 154(b) by 0 days.

(21) Appl. No.: 15/989,124

(22) Filed: May 24, 2018

(65) Prior Publication Data

US 2018/0258436 A1    Sep. 13, 2018

Related U.S. Application Data

(63) Continuation of application No. 15/287,624, filed on Oct. 6, 2016, now Pat. No. 10,041,077.

(60) Provisional application No. 62/239,109, filed on Oct. 8, 2015, provisional application No. 62/325,872, filed on Apr. 21, 2016, provisional application No. 62/373,422, filed on Aug. 11, 2016.

(51) Int. Cl.
| | |
|---|---|
| *C12N 15/00* | (2006.01) |
| *C12N 15/67* | (2006.01) |
| *C12N 9/12* | (2006.01) |
| *C12N 15/90* | (2006.01) |
| *C12N 15/10* | (2006.01) |
| *C12N 15/52* | (2006.01) |
| *C12N 15/62* | (2006.01) |
| *C12N 15/63* | (2006.01) |
| *C12N 15/81* | (2006.01) |
| *C12N 15/85* | (2006.01) |
| *C12R 1/84* | (2006.01) |
| *C12R 1/865* | (2006.01) |

(52) U.S. Cl.
CPC ............. *C12N 15/67* (2013.01); *C12N 9/12* (2013.01); *C12N 9/1241* (2013.01); *C12N 15/1082* (2013.01); *C12N 15/52* (2013.01); *C12N 15/625* (2013.01); *C12N 15/63* (2013.01); *C12N 15/81* (2013.01); *C12N 15/815* (2013.01); *C12N 15/85* (2013.01); *C12N 15/8509* (2013.01); *C12N 15/90* (2013.01); *C12R 1/84* (2013.01); *C12R 1/865* (2013.01); *C12Y 207/00* (2013.01); *C12Y 207/07* (2013.01); *C07K 2319/09* (2013.01); *C12N 2800/90* (2013.01); *C12N 2830/007* (2013.01); *C12N 2830/40* (2013.01); *C12N 2830/42* (2013.01); *C12N 2840/203* (2013.01)

(58) Field of Classification Search
CPC ........ C12N 15/67; C12N 15/63; C12N 15/79; C12N 15/85
See application file for complete search history.

(56) References Cited

U.S. PATENT DOCUMENTS

| | | | |
|---|---|---|---|
| 6,312,912 B1 | 11/2001 | Hope et al. |
| 6,410,314 B1 | 6/2002 | Baiker et al. |
| 6,623,958 B1 | 9/2003 | Harrington |
| 8,399,643 B2 | 3/2013 | Ostertag et al. |
| 8,546,643 B2 | 10/2013 | Bentzon et al. |
| 8,551,774 B2 | 10/2013 | Durocher |
| 8,900,871 B2 | 12/2014 | Okita et al. |
| 9,428,767 B2 | 8/2016 | Minshull et al. |
| 9,534,234 B2 | 1/2017 | Minshull et al. |
| 9,574,209 B2 | 2/2017 | Minshull et al. |
| 9,580,697 B2 | 2/2017 | Minshull et al. |
| 10,041,077 B2 | 8/2018 | Minshull et al. |
| 2003/0150007 A1 | 8/2003 | Savakis et al. |
| 2004/0096972 A1 | 5/2004 | Audit et al. |
| 2004/0110295 A1 | 6/2004 | Punnonen et al. |
| 2004/0203158 A1 | 10/2004 | Hackett et al. |
| 2005/0060762 A1 | 3/2005 | Bleck |
| 2007/0190031 A1 | 8/2007 | Sidhu et al. |
| 2009/0042297 A1 | 2/2009 | George, Jr. et al. |
| 2009/0186020 A1 | 7/2009 | Cunningham et al. |
| 2009/0197244 A1 | 8/2009 | Stuyver et al. |
| 2010/0138939 A1 | 6/2010 | Bentzon et al. |
| 2010/0146655 A1 | 6/2010 | Fahrenkrug et al. |
| 2010/0154070 A1 | 6/2010 | Xu et al. |
| 2010/0223683 A1 | 9/2010 | Wu et al. |
| 2011/0099649 A1 | 4/2011 | Meir et al. |
| 2011/0130444 A1 | 6/2011 | Moisyadi et al. |
| 2012/0040401 A1 | 2/2012 | Ellis et al. |
| 2012/0087862 A1 | 4/2012 | Hood et al. |
| 2012/0225034 A1 | 9/2012 | Belayew et al. |

(Continued)

FOREIGN PATENT DOCUMENTS

| | | |
|---|---|---|
| CA | 2394142 A1 | 6/2001 |
| WO | WO 03/044202 A1 | 5/2003 |

(Continued)

OTHER PUBLICATIONS

Abe et al., "Novel non-autonomous transposable elements on W chromosome of the silkworm, Bombyx mori," Journal of Genetics, 89(3):375-387, (2010).

(Continued)

*Primary Examiner* — Valarie E Bertoglio
(74) *Attorney, Agent, or Firm* — Alston & Bird LLP

(57) ABSTRACT

The present invention provides polynucleotide vectors for high expression of heterologous genes. Some vectors further comprise novel transposons and transposases that further improve expression. Further disclosed are vectors that can be used in a gene transfer system for stably introducing nucleic acids into the DNA of a cell. The gene transfer systems can be used in methods, for example, gene expression, bioprocessing, gene therapy, insertional mutagenesis, or gene discovery.

20 Claims, No Drawings
Specification includes a Sequence Listing.

(56) References Cited

U.S. PATENT DOCUMENTS

| | | |
|---|---|---|
| 2013/0045539 A1 | 2/2013 | Delenda et al. |
| 2013/0160152 A1 | 6/2013 | Ostertag et al. |
| 2014/0178914 A1 | 6/2014 | Minshull et al. |
| 2015/0158927 A1 | 6/2015 | Hantash |
| 2015/0232836 A1 | 8/2015 | Krieg et al. |
| 2015/0232862 A1 | 8/2015 | Graves et al. |
| 2015/0291975 A1 | 10/2015 | Minshull et al. |
| 2017/0101630 A1 | 4/2017 | Minshull et al. |
| 2017/0101646 A1 | 4/2017 | Minshull et al. |
| 2017/0101647 A1 | 4/2017 | Minshull et al. |
| 2019/0010505 A1 | 1/2019 | Minshull et al. |

FOREIGN PATENT DOCUMENTS

| | | |
|---|---|---|
| WO | WO 08/020960 A1 | 2/2008 |
| WO | WO 09/003671 A2 | 1/2009 |
| WO | WO 10/099301 A2 | 9/2010 |
| WO | WO 13/012824 A2 | 1/2013 |
| WO | WO 14/125382 A2 | 8/2014 |
| WO | WO 14/140218 A1 | 9/2014 |
| WO | WO 15/157579 A2 | 10/2015 |
| WO | WO 2017/062668 A2 | 4/2017 |

OTHER PUBLICATIONS

Abe et al., GenBank: AB480234.1, "Bornbyx mori DNA, contig W-5A2G-0O3, contains SINE:Bml," Sep. 2015. [Retrieved from the Internet Sep. 17, 2015: <URL: http://www.ncbi.nlm.nih.gov/nuccore/AB480234>].

Akhtar et al., "Chromatin Position Effects Assayed by Thousands of Reporters Integrated Parallel," Cell, 154(4):914-927, doi: 10.1016/j.cell.2013.07.018, (2013).

Akhtar et al., GenBank: Accession No. KC710230.1, "TRIP vector pPTK-Gal4-mPGK-Puro-Ires-eGFP-sNRP-pA-BC-Library, complete sequence," Sep. 18, 2013. [Retrieved from the Internet Mar. 20, 2017: <URL: https://www.ncbi.nlm.nih.gov/nucleotide/501416053?report=genbank&log$=nuclalign&blast_rank= 23&RID=D00HG21U016>].

Bauser et. al., "Proteins from nuclear extracts of two lepidopteran cell lines recognize the ends of TTAA-specific transposons piggyBac and tagalong," Insect Mol. Biol., 8(2):223-230, (1999).

Bhattacharyya et al., "An Apical GAGA Loop within 5' UTR of the Coxsackievirus B3 RNA Maintains Structural Organization of the IRES Element Required for Efficient Ribosome Entry," RNA Biology, 3(2):60-68, doi: 10.4161/rna.3.2.2990, (2006).

Cabianca et al., "A Long ncRNA Links Copy Number Variation to a Polycomb/Trithorax Epigenetic Switch in FSHD Muscular Dystrophy," Cell, 149(4):819-831, doi: 10.1016/j.cell.2012.03.035, (2012).

Cabiancca et al., GenBank: Accession No. JQ639078.1, "*Homo sapiens* DBE-T chromatin-associated long non-coding RNA, partial sequence," Apr. 4, 2014. [Retrieved from the Internet Mar. 21, 2017: <URL: https://www.ncbi.nlm.nih.gov/nucleotide/383506231?report=genbank&log$=nuclalign&blast_rank= 2&RID=D2VUJ9U8016>].

Daimon et. al., "Recent transposition of yabusame, a novel piggyBac-like transposable element in the genome of the silkworm, Bombyx mori," Genome, 53:585-593, (2010).

Demattei et al. "Nuclear Importation of Mariner Transposases among Eukaryotes: Motif Requirements and Homo-Protein Interactions," PLoS ONE, 6(8):e23693, 13 pages, doi:10.1371/journal.pone.0023693, (2011).

DOE Joint Genome Institute, GenBank: Accession No. XP_017949842.1, "PREDICTED: piggyBac transposable element-derived protein 4-like [Xenopus tropicalis]," Sep. 8, 2016. [Retrieved from the Internet Mar. 21, 2017: <URL: https://www.ncbi.nlm.nih.gov/protein/1062903160?report=genbank&log$=protalign&blast_rank=3&RID=CSK6WV84013>].

Drocourt et al., "Cassettes of the Streptoalloteichus hindustanus ble gene for transformation of lower and higher eukaryotes to phleomycin resistance," Nucleic Acids Research, 18(13):4009-4009, (1990).

EPO Application No.15776901.9 (published as EP3129487), Supplementary European Search Report and European Search Opinion dated Aug. 17, 2017.

Giulietti et al., "ExportAid: database of RNA elements regulating nuclear RNA export in mammals," Bioinformatics, 31(2): 246-251, (2015).

Grudzien-Nogalska et al., "Synthesis of Anti-Reverse Cap Analogs (ARCAs) and their Applications in mRNA Translation and Stability," Methods in Enzymology, 431:203-227, (2007).

Hellsten et al., "The Genome of the Western Clawed Frog *Xenopus tropicalis*," Science, 328(5978):633-636; doi: 10.1126/science.1183670, (2010).

Hikosaka et al., GenBank: Accession No. AB332396.1, "Xenopus (Silurana) tropicalis transposon TxpB_Uribo2 DNA, complete sequence," Dec. 20, 2010. [Retrieved from the Internet Mar. 17, 2017: <URL: https://www.ncbi.nlm.nih.gov/nucleotide/163954861?report=genbank&log$=nuclalign&blast_rank= 1&RID=CSRPJRN013>].

Hikosaka et al., GenBank: Accession No. BAF82022.1, "piggyBac transposase Uribo2 [Xenopus tropicalis]," Sep. 9, 2008. [Retrieved from the Internet Mar. 17, 2017: <URL:https://www.ncbi.nim.nih.gov/protein/158148977?report=genbank&log=protalign&blast_rank= 1&RID=CRYDB9MG016>].

Hikosaka et. al., "Evolution of the Xenopus piggyBac Transposon Family TxpB: Domesticated and Untamed Strategies of Transposon Subfamilies," Mol. Biol. Evol., 24(12):2648-2656, (2007). [Retrieved from the Internet Apr. 14, 2014: <URL: http://mbe.oxfordjournals.org>].

Kariko et al., "Incorporation of Pseudouridine Into mRNA Yields Superior Nonimmunogenic Vector With Increased Translational Capacity and Biological Stability," Molecular Therapy, 16(11):1833-1840. (2008).

Keith et al., "Analysis of the piggyBac transposase reveals a functional nuclear targeting signal in the 94 c-terminal residues," BMC Molecular Biology, 9:72, doi:10.1 186/1471-2199-9-72, pp. 1-13, (2008).

Kreidberg et al., "Genetic Analysis of the Human Thymidine Kinase Gene Promoter," Mol Cell Biol, 6(8):2903-2909, (1986).

Li et al. "A resurrected mammalian hAT transposable element and a closely related insect element are highly active in human cell culture," PNAS, 110(6):E478-E487, (2013). Published online Oct. 22, 2012.

Li et al., "Multiple myeloma risk variant at 7p15.3 creates an IRF4-binding site and interferes with CDCA7L expression," Nature Communications, 7:13656, pp. 1-9, (2016).

Li et al., "piggyBac transposase tools for genome engineering," PNAS, 110(25):E2279-E2287, doi: 10.1073/pnas.1305987110. (2013).

Li et al., "The piggyBac Transposon Displays Local and Distant Reintegration Preferences and Can Cause Mutations at Noncanonical Integration Sites," Mol Cell Biol, 33(7):1317-1330, (2013).

Liang et al., "Phylogenetic Analysis of the Species Theilovirus: Emerging Murine and Human Pathogens," J Virol. 82(23):11545-11554: doi: 10.1128/JVI.01160-08. (2008).

Liang et al., GenBank: Accession No. EU718733.1, "Theiler's encephalomyelitis virus isolate Vie415HTR, complete genome," Nov. 12, 2008. [Retrieved from the Internet Mar. 21, 2017: <URL: https://www.ncbi.nlm.nih.gov/nucleotide/195928288?report=genbank&log$=nuclalign&blast_rank= 3&RID=D2JE12BT013>].

Maragathavally et al., "Chimeric Mos1 and piggyBac transposases result in site-directed integration," FASEB J., 20:E1188-1195, (2006)

Mitra et al., "Functional characterization of piggyBat from the bat *Myotis lucifugus* unveils an active mammalian DNA transposon," PNAS, 110(1):234-239, (2013).

Mitra et al., "piggyBac can bypass DNA synthesis during cut and paste transposition," The EMBO Journal, 27:1097-1109, (2008).

Nishizawa et al., GenBank: Accession No. BAF82000.1, "human KIAA1094 protein homologue [Mus musculus]," Apr. 9, 2008. [Retrieved from the Internet Jul. 7, 2017: <URL: https://www.ncbi.nlm.nih.gov/protein/BAF82000>].

Oh et al., "Lentiviral vector design using alternative RNA export elements," Retrovirology, 4:38, 10 pages, doi:10.1186/1742-4690-4-38, (2007).

(56) References Cited

OTHER PUBLICATIONS

Okamoto et al., "Typing Hepatitis B Virus by Homology in Nucleotide Sequence: Comparison of Surface Antigen Subtypes," J Gen Virol, 69:2575-2583, (1988).
Okamoto et al., GenBank: Accession No. D00329.1, "Hepatitis B virus subtype ADW genomic DNA, complete genome, clone: pJDW233," Jul. 18, 2007. [Retrieved from the Internet Mar. 21, 2017: <URL: https://www.ncbi.nlm.nih.gov/nucleotide/221497?report=genbank&log$=nuclalign&blast_rank=15&RID=D2R2XAZ4013>].
Omuro et al., GenBank: AB162707.1, "Bombyx mori gene for putative transposase yabusame-.1, complete cds," Sept. 2015. [Retrieved from the Internet Sep. 17, 2015: <URL: http://www.ncbi.nlm.nih.gov/nuccore/AB162707.>].
Ottaviani et al., "The D4Z4 Macrosatellite Repeat Acts as a CTCF and A-Type Lamins-Dependent Insulator in Facio-Scapulo-Humeral Dystrophy," PLoS Genetics, 5(2):e1000394, 11 pages. doi:10.1371/journal.pgen.1000394. (2009).
Qin et al., "Systematic Comparison of Constitutive Promoters and the Doxycycline-Inducible Promoter." PLoS ONE. 5(5):e10611, doi:10.1371/journal.pone.0010611, (2010).
Sarkar et. al., "Molecular evolutionary analysis of widespread piggyBac transposon family and related 'domesticated' sequences," Mol Gen Genomics, 270(2):173-180, (2003).
Sun et al, "Posttranscriptional regulatory elements enhance antigen expression and DNA vaccine efficacy," DNA and cell Biology, 28:233-240, (2009).
Szuts et al., "LexA chimeras reveal the function of *Drosophila* Fos as a context-dependent transcriptional activator," PNAS, 97(10):5351-5356, (2000).
Tas et al., "An Integrated System for Precise Genome Modification in *Escherichia coli*," PLOS One; 10(9): e0136963, 19 pages. doi: 10.1371/journal.pone.0136963, (2015).
Tas et al., GenBank: Accession No. KR071149.1, "Donor vector pTKDP-neo, complete sequence," Sep. 17, 2015. [Retrieved from the Internet Mar. 21, 2017: <URL: https://www.ncbi.nlm.nih.gov/nucleotide/901703473?report=genbank&log$=nuclalign&blast_rank=16&RID=D2UWX8F401N>].
U.S. Appl. No. 14/683,097, Applicant Initiated Interview Summary dated Sep. 14, 2017.
U.S. Appl. No. 14/683,097, Final Office Action dated Jun. 22, 2018.
U.S. Appl. No. 14/683,097, Final Office Action dated Jul. 10, 2017.
U.S. Appl. No. 14/683,097, Non-Final Office Action dated Oct. 14, 2016.
U.S. Appl. No. 14/683,097, Non-Final Office Action dated Oct. 25, 2017.
U.S. Appl. No. 14/683,097, Requirement for Restriction/Election dated Apr. 12, 2016.
U.S. Appl. No. 14/683,097, Requirement for Restriction/Election dated Jul. 20, 2016.
U.S. Appl. No. 14/683,121, Advisory Action dated Mar. 30, 2016.
U.S. Appl. No. 14/683,121, Final Office Action dated Jan. 12, 2016.
U.S. Appl. No. 14/683,121, Non-Final Office Action dated Aug. 26, 2015.
U.S. Appl. No. 14/683,121, Notice of Allowance dated Apr. 25, 2016.
U.S. Appl. No. 14/683,126, Advisory Action dated Apr. 13, 2016.
U.S. Appl. No. 14/683,126, Final Office Action dated Mar. 1, 2016.
U.S. Appl. No. 14/683,126, Non-Final Office Action dated Nov. 23, 2015.
U.S. Appl. No. 14/683,126, Notice of Allowance dated Jul. 20, 2016.
U.S. Appl. No. 14/683,126, Requirement for Restriction/Election dated Aug. 6, 2015.
U.S. Appl. No. 15/195,905, Non-Final Office Action dated Sep. 12, 2016.
U.S. Appl. No. 15/195,905, Notice of Allowance dated Oct. 7, 2016.
U.S. Appl. No. 15/195,905, Notice of Allowance dated Nov. 25, 2016.
U.S. Appl. No. 15/222,830, Non-Final Office Action dated Sep. 9, 2016.
U.S. Appl. No. 15/222,830, Notice of Allowance dated Oct. 7, 2016.
U.S. Appl. No. 15/287616, Final Office Action dated Oct. 15, 2018.
U.S. Appl. No. 15/287,616, Non-Final Office Action dated Apr. 23, 2018.
U.S. Appl. No. 15/287,616, Requirement for Restriction/Election dated Jul. 10, 2017.
U.S. Appl. No. 15/287,622, Final Office Action dated Jun. 15, 2018.
U.S. Appl. No. 15/287,622, Final Office Action dated Sep. 13, 2018.
U.S. Appl. No. 15/287,622, Non-Final Office Action dated Mar. 8, 2018.
U.S. Appl. No. 15/287,622, Requirement for Restriction/Election dated Dec. 7, 2017.
U.S. Appl. No. 15/287,624, Advisory Action dated Oct. 19, 2017.
U.S. Appl. No. 15/287,624, Final Office Action dated Jul. 6, 2017.
U.S. Appl. No. 15/287,624, Non-Final Office Action dated Apr. 10, 2017.
U.S. Appl. No. 15/287,624, Non-Final Office Action dated Nov. 22, 2017.
U.S. Appl. No. 15/287,624, Notice of Allowance dated Apr. 4, 2018.
U.S. Appl. No. 15/287,660, Final Office Action dated Jun. 26, 2018.
U.S. Appl. No. 15/287,660, Non-Final Office Action dated Mar. 19, 2018.
U.S. Appl. No. 15/287,660, Notice of Allowance dated Oct. 24, 2018.
U.S. Appl. No. 15/287,660, Requirement for Restriction/Election dated Dec. 13, 2017.
Uetsuki et al., GenBank: Accession No. J04617.1, "Human elongation factor EF-1-alpha gene, complete cds," Nov. 7, 1994. [Retrieved from the Internet Jul. 7, 2017: <URL: https://www.ncbi.nlm.nih.gov/nuccore/J04617>].
Wang et al., "An Enhancer Element Harboring Variants Associated with Systemic Lupus Erythematosus Engages the TNFAIP3 Promoter to Influence A20 Expression," PLOS Genetics, 9(9):1-10, (2013).
Wang et al., "Large diversity of the piggyBac-like elements in the genome of Tribolium castaneum," Insect Biochem Mol Biol, 38(4):490-498, doi: 10.1016/j.ibmb.2007.04.012, (2008).
WIPO Application No. PCT/US2015/025209, PCT International Preliminary Report on Patentability dated Oct. 12, 2016.
WIPO Application No. PCT/US2015/025209, PCT International Search Report and Written Opinion of the International Searching Authority dated Oct. 26, 2015,
WIPO Application No. PCT/US2015/025209, PCT Invitation to Pay Additional Fees dated Jul. 30, 2015,
WIPO Application No. PCT/US2016/055824, PCT International Preliminary Report on Patentability dated Apr. 19, 2018.
WIPO Application No. PCT/US2016/055824, PCT International Search Report and Written Opinion of the International Searching Authority dated Jun. 20, 2017.
Wu et.al., "Cloning and characterization of piggyBac-like elements in lepidopteran insects," Genetica, 139:149-154, (2011).
Yan et al., "Genome sequencing and comparison of two nonhuman primate animal models, the cynomolgus and Chinese rhesus macaques," Nature Biotechnol, 29(11):1019-1023, doi: 10.1038/nbt.1992, (2011).
Yan et al., GenBank: Accession No. EHH27175.1, "PiggyBac transposable element-derived protein 4 [Macaca mulatta]," Mar. 17, 2015. [Retrieved from the Internet Mar. 21, 2017: <URL: https://www.ncbi.nlm.nih.gov/protein/355692572?report=genbank&log$=protalign&blast_rank=27&RID=D395UNFA016>].
Yusa et. al., "A hyperactive piggyBac transposase for mammalian applications," PNAS, 108(4):1531-1536, (2011).
Yusufzai et. al., "The 5-HS4 chicken β-globin insulator is a CTCF-dependent nuclear matrix-associated element," PNAS, 101(23):8620-8624, (2004).
Zheng et al., "Cell-Type-Specific Regulation of Degradation of Hypoxia-Inducible Factor 1α:Role of Subcelluar Compartmentalization," Mol. Cell. Biol., 26(12):4628-4641, (2006).
Abe et al., "Novel non-autonomous transposable elements on W chromosome of the silkworm, *Bombyx mori*," Journal of Genetics, Indian Academy of Sciences, 89(3):375-387, (2010).

(56) References Cited

OTHER PUBLICATIONS

Daimon et al., "Recent transposition of yabusame, a novel piggyBac-like transposable element in the genome of the silkworm, *Bombyx mori*," Genome, NRC Research Press, 53:585-593, doi:1 0.1139/010-035, (2010).
Database UniProt: EBI Accession No. UNIPROT:Q7SQCO "Putative transposase yabusame-1," Jul. 5, 2004. [Retrieved from the Internet Apr. 2, 2019: <URL: https://www.uniprot.org/uniprot/Q7SQCO>].
EP Application No. 168543544 (Published as EP3359671), Supplementary European Search Report and European Search Opinion dated Feb. 20, 2019.
KEITH et al., "Mutational analysis of highly conserved aspartate residues essential to the catalytic core of the piggyBac transposase," BMC Molecular Biology, 9:73, 20 pages, doi:10.1186/1471-2199-9-73. (2008).
U.S. Appl. No. 15/287,616, Notice of Allowance dated Feb. 28, 2019.
U.S. Appl. No. 15/287,622, Non-Final Office Action dated Jan. 28, 2019.
U.S. Appl. No. 61/977,474, filed Apr. 9, 2014, Expired.
U.S. Appl. No. 62/003,397, filed May 27, 2014, Expired.
U.S. Appl. No. 62/046,875, filed Sep. 5, 2014, Expired.
U.S. Appl. No. 62/046,705, filed Sep. 5, 2014, Expired.
U.S. Appl. No. 62/069,656, filed Oct. 28, 2014, Expired.
U.S. Appl. No. 62/120,522, filed Feb. 25, 2015, Expired.
U.S. Appl. No. 14/683,097, filed Apr. 9, 2015, US 2015-0291975, Pending.
U.S. Appl. No. 14/683,121, filed Apr. 9, 2015, U.S. Pat. No. 9,428,767, Issued.
U.S. Appl. No. 14/683,126, filed Apr. 9, 2015, U.S. Pat. No. 9,534,234, Issued.
PCT/US2015/02520, filed Apr. 9, 2015, WO 2015/157579, Expired.
U.S. Appl. No. 62/239,109, filed Oct. 8, 2015, Expired.
U.S. Appl. No. 62/325,872, filed Apr. 21, 2016, Expired.
U.S. Appl. No. 15/195,905, filed Jun. 28, 2016, U.S. Pat. No. 9,574,209, Issued.
U.S. Appl. No. 15/222,830, filed Jul. 28, 2016, U.S. Pat. No. 9,580,697, Issued.
U.S. Appl. No. 62/373,422, filed Aug. 11, 2016, Expired.
U.S. Appl. No. 15/287,616, filed Oct. 6, 2016, US 2017-0101646, Pending.
U.S. Appl. No. 15/287,622, filed Oct. 6, 2016, US 2017-0101647, Pending.
U.S. Appl. No. 15/287,624, filed Oct. 6, 2016, U.S. Pat. No. 10,041,077, Issued.
U.S. Appl. No. 15/287,660, filed Oct. 6, 2016, US 2017-0101630, Pending.
PCT/US2016/05582, filed Oct. 6, 2016, WO 2017/062668, Expired.

DNA VECTORS, TRANSPOSONS AND TRANSPOSASES FOR EUKARYOTIC GENOME MODIFICATION

CROSS REFERENCE TO RELATED APPLICATIONS

The present application is a continuation of U.S. Ser. 15/287,624 filed Oct. 6, 2016, which claims priority from U.S. 62/373,422 filed Aug. 11, 2016, U.S. 62/325,872 filed Apr. 21, 2016, and U.S. 62/239,109 filed Oct. 8, 2015, each of which is incorporated by reference. The present application is also related to 61/977,474 filed Apr. 9, 2014, 62/003, 397 filed May 17, 2014, 62/046,875 filed Sep. 5, 2014, 62/046,705, filed Sep. 5, 2014, 62/069,656 filed Oct. 28, 2014, 62/120,522 filed Feb. 25, 2015 PCT/US2015/025209, filed Apr. 9, 2015, each incorporated by reference in its entirety for all purposes.

REFERENCE TO A SEQUENCE LISTING SUBMITTED IN A COMPUTER READABLE FORMAT

The application includes an electronic sequence listing in a file named 514205_SEQLST.TXT, created on May 24, 2018 and containing 299,832 bytes, which is here by incorporated by reference in its entirety for all purposes.

2. BACKGROUND OF THE INVENTION

The efficiency with which a first polynucleotide can effect the integration of heterologous DNA into the genome of a target cell depends on the configuration of sequence elements within the polynucleotide. The expression levels of genes encoded by the integrated heterologous DNA also depend on the configuration of sequence elements within the integrated heterologous DNA. The efficiency of integration, the size of the heterologous DNA sequence that can be integrated, the number of copies of the heterologous DNA sequence that are integrated into each genome and the type of genomic loci where integration occurs can often be further improved by placing the heterologous DNA into a transposon.

Transposons comprise two ends that are recognized by a transposase. The transposase acts on the transposon to remove it from one DNA molecule and integrate it into another. The DNA between the two transposon ends is transposed by the transposase along with the transposon ends. Heterologous DNA flanked by a pair of transposon ends, such that it is recognized and transposed by a transposase is referred to herein as a synthetic transposon. Introduction of a synthetic transposon and a corresponding transposase into the nucleus of a eukaryotic cell may result in transposition of the transposon into the genome of the cell. More active (hyperactive) transposons and transposases result in a higher frequency of transposition, leading to a higher fraction of cells whose genomes contain an integrated copy of the transposon and/or cells whose genomes contain a larger number of integrated copies of the transposon. These outcomes are useful because they increase transformation efficiencies and because they can increase expression levels from integrated heterologous DNA. There is thus a need in the art for hyperactive transposases and transposons.

Transposition by a piggyBac-like transposase is perfectly reversible. The transposon is initially integrated at an integration target sequence in a recipient DNA molecule, during which the target sequence becomes duplicated at each end of the transposon inverted terminal repeats (ITRs). Subsequent transposition removes the transposon and restores the recipient DNA to its former sequence, with the target sequence duplication and the transposon removed. However, this is not sufficient to remove a transposon from a genome into which it has been integrated, as it is highly likely that the transposon will be excised from the first integration target sequence but integrated into a second integration target sequence in the genome. Transposases that are deficient for the integration function, on the other hand, can excise the transposon from the first target sequence, but will be unable to integrate into a second target sequence. Integration-deficient transposases are thus useful for reversing the genomic integration of a transposon.

3. SUMMARY OF THE INVENTION

Heterologous gene expression from polynucleotide constructs that stably integrate into a target cell genome can be improved by placing the expression polynucleotide between a pair of transposon ends: sequence elements that are recognized and transposed by transposases. DNA sequences inserted between a pair of transposon ends can be excised by a transposase from one DNA molecule and inserted into a second DNA molecule. Two novel piggyBac-like transposon-transposase systems are disclosed that are not derived from the looper moth *Trichoplusia ni*; one is derived from the silkworm *Bombyx mori* and the other is derived from the frog *Xenopus tropicalis*. Each of these comprises sequences that function as transposon ends and that can be used in conjunction with a corresponding transposase that recognizes and acts on those transposon ends, as gene transfer systems for stably introducing nucleic acids into the DNA of a cell. Hyperactive and integration-deficient transposase variants are also disclosed.

Thus, the invention provides sequences of hyperactive *Xenopus* transposases that are at least 90% identical to SEQ ID NO: 61, and positions and amino acid substitutions that can be introduced either to enhance transposase activity, or to maintain function of the transposase The invention also provides sequences of transposon ends comprising at least 16 contiguous bases from SEQ ID NO: 7 and at least 16 contiguous bases from SEQ ID NO: 16, and inverted terminal repeats SEQ ID NO: 19. These sequences, when placed on either side of a heterologous polynucleotide, create a synthetic *Xenopus* transposon which can be excised from a polynucleotide by *Xenopus* transposases. The synthetic transposon may be integrated into a target genome by a *Xenopus* transposase.

The invention provides sequences of hyperactive *Bombyx* transposases that are at least 90% identical to SEQ ID NO: 415, and positions and amino acid substitutions that can be introduced either to enhance transposase activity, or to maintain function of the transposase The invention also provides sequences of transposon ends comprising at least 16 contiguous bases from SEQ ID NO: 25 and at least 16 contiguous bases from SEQ ID NO: 31, and inverted terminal repeats that are at least 87% identical to SEQ ID NO: 33. These sequences, when placed on either side of a heterologous polynucleotide, create a synthetic *Bombyx* transposon which can be excised from a polynucleotide by *Bombyx* transposases. The synthetic transposon may be integrated into a target genome by a *Bombyx* transposase.

The invention provides methods for integrating a heterologous polynucleotide into the genome of a target cell, by introducing a *Xenopus* transposon and a *Xenopus* transposase, or a *Bombyx* transposase and a *Bombyx* transposon, into a target cell. The transposase may be introduced as protein, or as a polynucleotide encoding the transposase and expressible in the target cell.

The invention also provides vector configurations, including transposon configurations, that are particularly advantageous for expression of genes in mammalian systems.

The transposons and transposases of the present invention can be used in methods, for example, but not limited to, heterologous gene expression, gene therapy, insertional mutagenesis, or gene discovery.

4. BRIEF DESCRIPTION OF THE CONSTRUCT COMPOSITIONS AND EXPERIMENTAL PROCEDURES 4.1 Construct Compositions SEQ ID NO: 39 contains a weak promoter (the murine phosphoglycerate kinase (PGK) promoter, SEQ ID NO: 937), operably linked to a single open reading frame encoding DasherGFP translationally coupled via a CHYSEL sequence to puromycin N-acetyl transferase, followed by the polyadenylation signal from human beta globin.

SEQ ID NO: 40 comprises a weak promoter (the murine phosphoglycerate kinase (PGK) promoter, SEQ ID NO: 937), operably linked to an open reading frame encoding puromycin N-acetyl transferase, followed by the polyadenylation signal from human beta globin. SEQ ID NO: 40 also comprises the EF1a promoter operably linked to a gene encoding DasherGFP followed by expression enhancing elements SEQ ID 866 and the rabbit globin polyadenylation sequence.

4.2 Experimental Procedures 4.2.1 Transfection and Selection of CHO-K1

CHO-K1 cells (from ATCC) were grown in F12-K (from ATCC)+10% FBS (from ATCC)+1% Penicillin-streptomycin (from ATCC) at 37° C., 5% $CO_2$ to 80% confluence. 500,000 cells were plated in 24-well tissue culture plates and incubated at 37° C., 5% $CO_2$ for 24 hours prior to transfection. Transfections were performed in triplicate. Each transfection used a total of 500-1,000 ng DNA with Roche Extreme Gene 9 reagent (2:1 ratio) as per manufacturer's protocol. Media with 50 µg/ml puromycin was added 72 hours post transfection. Puromycin selection was carried out for 72 hours, after which puromycin was removed. Cells were grown for 14 days post puromycin selection with two passages and changes of media. Cells were harvested by scraping and measured in a fluorimetric plate reader.

4.2.2 Transfection and Selection of CHO-S

CHO-S cells (from ATCC) were grown in CHOgro expression medium (from Mirus) at 37° C., 5% $CO_2$ and seeded at $2 \times 10^6$ cells/ml. 1 ml of cells were transfected with 1 µg total nucleic acid. Transfections were performed in duplicate. Each transfection used Mirus Transit-Pro and Mirus TransIT-mRNA reagent as per manufacturer's protocol. Media with puromycin was added 72 hours post transfection. Puromycin selection was carried out for the number of days indicated, with a complete media change into fresh puromycin-containing media after 5 days.

4.2.3 mRNA Preparation mRNA encoding transposases was prepared by in vitro transcription using T7 RNA polymerase. The mRNA comprised a 5' sequence SEQ ID NO: 699 preceding the sequence encoding the open reading frame, and a 3' sequence SEQ ID NO: 700 following the stop codon at the end of the open reading frame. The mRNA had an anti-reverse cap analog (3'-O-Me-m$^7$G(5')ppp(5')G, and was fully substituted with pseudo-uridine and 5-methyl-cytosine.

5. DETAILED DESCRIPTION OF THE INVENTION 5.1 Definitions

Use of the singular forms "a," "an," and "the" include plural references unless the context clearly dictates otherwise. Thus, for example, reference to "a polynucleotide" includes a plurality of polynucleotides, reference to "a substrate" includes a plurality of such substrates, reference to "a variant" includes a plurality of variants, and the like.

Terms such as "connected," "attached," "linked," and "conjugated" are used interchangeably herein and encompass direct as well as indirect connection, attachment, linkage or conjugation unless the context clearly dictates otherwise. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the invention. Where a value being discussed has inherent limits, for example where a component can be present at a concentration of from 0 to 100%, or where the pH of an aqueous solution can range from 1 to 14, those inherent limits are specifically disclosed. Where a value is explicitly recited, it is to be understood that values which are about the same quantity or amount as the recited value are also within the scope of the invention. Where a combination is disclosed, each sub combination of the elements of that combination is also specifically disclosed and is within the scope of the invention. Conversely, where different elements or groups of elements are individually disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Unless defined otherwise herein, all technical and scientific terms used herein have the same meaning as commonly understood by one of ordinary skill in the art to which this invention belongs. Singleton, et al., *Dictionary of Microbiology and Molecular Biology*, 2nd Ed., John Wiley and Sons, New York (1994), and Hale & Marham, *The Harper Collins Dictionary of Biology*, Harper Perennial, N Y, 1991, provide one of skill with a general dictionary of many of the terms used in this invention. Although any methods and materials similar or equivalent to those described herein can be used in the practice or testing of the present invention, the preferred methods and materials are described. Unless otherwise indicated, nucleic acids are written left to right in 5' to 3' orientation; amino acid sequences are written left to right in amino to carboxy orientation, respectively. The terms defined immediately below are more fully defined by reference to the specification as a whole.

The "configuration" of a polynucleotide means the functional sequence elements within the polynucleotide, and the order and direction of those elements.

The terms "corresponding transposon" and "corresponding transposase" are used to indicate an activity relationship between a transposase and a transposon. A transposase transposases its corresponding transposon. Many transposases may correspond with a single transposon, for example all of SEQ ID NOS: 52-402 are corresponding transposases for transposon SEQ ID NO: 44). A transposon is transposed by its corresponding transposase. Many transposons may correspond with a single transposase, for example the transposons shown in Table 5 rows 4-21 are all corresponding transposons for transposase SEQ ID NO: 48.

The term "counter-selectable marker" means a polynucleotide sequence that confers a selective disadvantage on a host cell. Examples of counter-selectable markers include sacB, rpsL, tetAR, pheS, thyA, gata-1, ccdB, kid and barnase (Bernard, 1995, Journal/Gene, 162: 159-160; Bernard et al., 1994. Journal/Gene, 148: 71-74; Gabant et al., 1997, Journal/Biotechniques, 23: 938-941; Gababt et al., 1998, Journal/Gene, 207: 87-92; Gababt et al., 2000, Journal/Biotechniques, 28: 784-788; Galvao and de Lorenzo, 2005, Journal/Appl Environ Microbiol, 71: 883-892; Hartzog et al., 2005, Journal/Yeat, 22:789-798; Knipfer et al., 1997, Journal/Plasmid, 37: 129-140; Reyrat et al., 1998, Journal/Infect Immun, 66: 4011-4017; Soderholm et al., 2001, Journal/Biotechniques, 31: 306-310, 312; Tamura et al., 2005, Journal/Appl Environ Microbiol, 71: 587-590; Yazynin et al., 1999, Journal/FEBS Lett, 452: 351-354). Counter-selectable markers often confer their selective disadvantage in specific contexts. For example, they may confer sensitivity to compounds that can be added to the environment of the host cell, or they may kill a host with one genotype but not kill a host with a different genotype. Conditions which do not confer a selective disadvantage on a cell carrying a counter-selectable marker are described as "permissive". Conditions which do confer a selective disadvantage on a cell carrying a counter-selectable marker are described as "restrictive".

The term "coupling element" or "translational coupling element" means a DNA sequence that allows the expression of a first polypeptide to be linked to the expression of a second polypeptide. Internal ribosome entry site elements (IRES elements) and cis-acting hydrolase elements (CHYSEL elements) are examples of coupling elements.

The terms "DNA sequence", "RNA sequence" or "polynucleotide sequence" mean a contiguous nucleic acid sequence. The sequence can be an oligonucleotide of 2 to 20 nucleotides in length to a full length genomic sequence of thousands or hundreds of thousands of base pairs.

The term "expression construct" means any polynucleotide designed to transcribe an RNA. For example, a construct that contains at least one promoter which is or may be operably linked to a downstream gene, coding region, or polynucleotide sequence (for example, a cDNA or genomic DNA fragment that encodes a polypeptide or protein, or an RNA effector molecule, for example, an antisense RNA, triplex-forming RNA, ribozyme, an artificially selected high affinity RNA ligand (aptamer), a double-stranded RNA, for example, an RNA molecule comprising a stem-loop or hairpin dsRNA, or a bi-finger or multi-finger dsRNA or a microRNA, or any RNA). An "expression vector" is a polynucleotide comprising a promoter which can be operably linked to a second polynucleotide. Transfection or transformation of the expression construct into a recipient cell allows the cell to express an RNA effector molecule, polypeptide, or protein encoded by the expression construct. An expression construct may be a genetically engineered plasmid, virus, recombinant virus, or an artificial chromosome derived from, for example, a bacteriophage, adenovirus, adeno-associated virus, retrovirus, lentivirus, poxvirus, or herpesvirus. Such expression vectors can include sequences from bacteria, viruses or phages. Such vectors include chromosomal, episomal and virus-derived vectors, for example, vectors derived from bacterial plasmids, bacteriophages, yeast episomes, yeast chromosomal elements, and viruses, vectors derived from combinations thereof, such as those derived from plasmid and bacteriophage genetic elements, cosmids and phagemids. An expression construct can be replicated in a living cell, or it can be made synthetically. For purposes of this application, the terms "expression construct", "expression vector", "vector", and "plasmid" are used interchangeably to demonstrate the application of the invention in a general, illustrative sense, and are not intended to limit the invention to a particular type of expression construct.

The term "expression polypeptide" means a polypeptide encoded by a gene on an expression construct.

The term "expression system" means any in vivo or in vitro biological system that is used to produce one or more gene product encoded by a polynucleotide.

A "gene transfer system" comprises a vector or gene transfer vector, or a polynucleotide comprising the gene to be transferred which is cloned into a vector (a "gene transfer polynucleotide" or "gene transfer construct"). A gene transfer system may also comprise other features to facilitate the process of gene transfer. For example, a gene transfer system may comprise a vector and a lipid or viral packaging mix for enabling a first polynucleotide to enter a cell, or it may comprise a polynucleotide that includes a transposon and a second polynucleotide sequence encoding a corresponding transposase to enhance productive genomic integration of the transposon. The transposases and transposons of a gene transfer system may be on the same nucleic acid molecule or on different nucleic acid molecules. The transposase of a gene transfer system may be provided as a polynucleotide or as a polypeptide.

Two elements are "heterologous" to one another if not naturally associated. For example, a nucleic acid sequence encoding a protein linked to a heterologous promoter means a promoter other than that which naturally drives expression of the protein. A heterologous nucleic acid flanked by transposon ends or ITRs means a heterologous nucleic acid not naturally flanked by those transposon ends or ITRs, such as a nucleic acid encoding a polypeptide other than a transposase, including an antibody heavy or light chain. A nucleic acid is heterologous to a cell if not naturally found in the cell or if naturally found in the cell but in a different location (e.g., episomal or different genomic location) than the location described.

The term "host" means any prokaryotic or eukaryotic organism that can be a recipient of a nucleic acid. A "host," as the term is used herein, includes prokaryotic or eukaryotic organisms that can be genetically engineered. For examples of such hosts, see Maniatis et al., Molecular Cloning. A Laboratory Manual, Cold Spring Harbor Laboratory, Cold Spring Harbor, N.Y. (1982). As used herein, the terms "host," "host cell," "host system" and "expression host" can be used interchangeably.

A "hyperactive" transposase is a transposase that is more active than the naturally occurring transposase from which it is derived. "Hyperactive" transposases are thus not naturally occurring sequences. Hyperactive *Xenopus* transposases are those that are more active than SEQ ID NO: 48. Hyperactive *Bombyx* transposases are those that are more active than SEQ ID NO: 407.

'Integration defective' means a transposase that can excise its corresponding transposon, but that integrates the excised transposon at a lower frequency into the host genome than a corresponding naturally occurring transposase. Integration defective *Xenopus* transposases are deficient relative to SEQ ID NO: 48. Integration defective *Bombyx* transposases are deficient relative to SEQ ID NO: 407.

An "IRES" or "internal ribosome entry site" means a specialized sequence that directly promotes ribosome binding, independent of a cap structure.

An 'isolated' polypeptide or polynucleotide means a polypeptide or polynucleotide that has been either removed from its natural environment, produced using recombinant techniques, or chemically or enzymatically synthesized. Polypeptides or polynucleotides of this invention may be purified, that is, essentially free from any other polypeptide or polynucleotide and associated cellular products or other impurities.

The terms "nucleoside" and "nucleotide" include those moieties which contain not only the known purine and pyrimidine bases, but also other heterocyclic bases which have been modified. Such modifications include methylated purines or pyrimidines, acylated purines or pyrimidines, or other heterocycles. Modified nucleosides or nucleotides can also include modifications on the sugar moiety, for example, where one or more of the hydroxyl groups are replaced with halogen, aliphatic groups, or is functionalized as ethers, amines, or the like. The term "nucleotidic unit" is intended to encompass nucleosides and nucleotides.

An "Open Reading Frame" or "ORF" means a portion of a polynucleotide that, when translated into amino acids, contains no stop codons. The genetic code reads DNA sequences in groups of three base pairs, which means that a double-stranded DNA molecule can read in any of six possible reading frames-three in the forward direction and three in the reverse. An ORF typically also includes an initiation codon at which translation may start.

The term "operably linked" refers to functional linkage between two sequences such that one sequence modifies the behavior of the other. For example, a first polynucleotide comprising a nucleic acid expression control sequence (such as a promoter, IRES sequence, enhancer or array of transcription factor binding sites) and a second polynucleotide are operably linked if the first polynucleotide affects transcription and/or translation of the second polynucleotide. Similarly, a first amino acid sequence comprising a secretion signal or a subcellular localization signal and a second amino acid sequence are operably linked if the first amino acid sequence causes the second amino acid sequence to be secreted or localized to a subcellular location.

The term "overhang" or "DNA overhang" means the single-stranded portion at the end of a double-stranded DNA molecule. Complementary overhangs are those which will base-pair with each other.

A "piggyBac-like transposase" means a transposase with at least 20% sequence identity as identified using the TBLASTN algorithm to the piggyBac transposase from *Trichoplusia ni* (SEQ ID NO: 698), and as more fully described in Sakar, A. et. al., (2003). Mol. Gen. Genomics 270: 173-180. "Molecular evolutionary analysis of the widespread piggyBac transposon family and related 'domesticated' species", and further characterized by a DDE-like DDD motif, with aspartate residues at positions corresponding to D268, D346, and D447 of *Trichoplusia ni* piggyBac transposase on maximal alignment. PiggyBac-like transposases are also characterized by their ability to excise their transposons precisely with a high frequency. A "piggyBac-like transposon" means a transposon having transposon ends which are the same or at least 80% and preferably at least 90, 95, 96, 97, 98 or 99% identical to the transposon ends of a naturally occurring transposon that encodes a piggyBac-like transposase. A piggyBac-like transposon includes an inverted terminal repeat (ITR) sequence of approximately 12-16 bases at each end, and is flanked on each side by a 4 base sequence corresponding to the integration target sequence which is duplicated on transposon integration (the Target Site Duplication or Target Sequence Duplication or TSD). PiggyBac-like transposons and transposases occur naturally in a wide range of organisms including *Argyrogramma agnate* (GU477713), *Anopheles gambiae* (XP_312615; XP_320414; XP_310729), *Aphis gossypii* (GU329918), *Acyrthosiphon pisum* (XP_001948139), *Agrotis ypsilon* (GU477714), *Bombyx mori* (BAD11135), *Ciona intestinalis* (XP_002123602), *Chilo suppressalis* (JX294476), *Drosophila melanogaster* (AAL39784), *Daphnia pulicaria* (AAM76342), *Helicoverpa armigera* (ABS18391), *Homo sapiens* (NP_689808), *Heliothis virescens* (ABD76335), *Macdunnoughia crassisigna* (EU287451), *Macaca fascicularis* (AB179012), *Mus musculus* (NP_741958), *Pectinophora gossypiella* (GU270322), *Rattus norvegicus* (XP_220453), *Tribolium castaneum* (XP_001814566), *Trichoplusia ni* (AAA87375) and *Xenopus tropicalis* (BAF82026), although transposition activity has been described for almost none of these.

The terms "polynucleotide," "oligonucleotide," "nucleic acid" and "nucleic acid molecule" and "gene" are used interchangeably to refer to a polymeric form of nucleotides of any length, and may comprise ribonucleotides, deoxyribonucleotides, analogs thereof, or mixtures thereof. This term refers only to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the terms "polynucleotide," "oligonucleotide," "nucleic acid" and "nucleic acid molecule" include polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N- or C-glycoside of a purine or pyrimidine base, and other polymers containing nonnucleotidic backbones, for example, polyamide (for example, peptide nucleic acids ("PNAs")) and polymorpholino (commercially available from the Anti-Virals, Inc., Corvallis, Oreg., as Neugene) polymers, and other synthetic sequence-specific nucleic acid polymers providing that the polymers contain nucleobases in a configuration which allows for base pairing and base stacking, such as is found in DNA and RNA. There is no intended distinction in length between the terms "polynucleotide," "oligonucleotide," "nucleic acid" and "nucleic acid molecule," and these terms are used interchangeably herein. These terms refer only to the primary structure of the molecule. Thus, these terms include, for example, 3'-deoxy-2', 5'-DNA, oligodeoxyribonucleotide N3' P5' phosphoramidates, 2'-O-alkyl-substituted RNA, double- and single-stranded DNA, as well as double- and single-stranded RNA, and hybrids thereof including for example hybrids between DNA and RNA or between PNAs and DNA or RNA, and also include known types of modifications, for example, labels, alkylation, "caps," substitution of one or more of the nucleotides with an analog, internucleotide modifications such as, for example, those with uncharged linkages (for example, methyl phosphonates, phosphotriesters, phosphoramidates, carbamates, or the like) with negatively charged linkages (for example, phosphorothioates, phosphorodithioates, or the like), and with positively charged linkages (for example, aminoalkylphosphoramidates, aminoalkylphosphotriesters), those containing pendant moieties, such as, for example, proteins (including enzymes (for example, nucleases), toxins, antibodies, signal peptides, poly-L-lysine, or the like), those with intercalators (for example, acridine, psoralen, or the like), those containing chelates (of, for example, metals, radioactive metals, boron, oxidative metals, or the like), those containing alkylators, those with modified linkages (for example, alpha anomeric nucleic acids, or the like), as well as unmodified forms of the polynucleotide or oligonucleotide.

A "promoter" means a nucleic acid sequence sufficient to direct transcription of an operably linked nucleic acid molecule. Also included in this definition are those transcription control elements (for example, enhancers) that are sufficient to render promoter-dependent gene expression controllable in a cell type-specific, tissue-specific, or temporal-specific manner, or that are inducible by external signals or agents; such elements, may be within the 3' region of a gene or within an intron. Desirably, a promoter is operably linked to a nucleic acid sequence, for example, a cDNA or a gene sequence, or an effector RNA coding sequence, in such a way as to enable expression of the nucleic acid sequence, or a promoter is provided in an expression cassette into which a selected nucleic acid sequence to be transcribed can be conveniently inserted.

The term "selectable marker" means a polynucleotide segment that allows one to select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions. Examples of selectable markers include but are not limited to: (1) DNA segments that encode products which provide resistance against otherwise toxic compounds (e.g., antibiotics); (2) DNA segments that encode products which are otherwise lacking in the recipient cell (e.g., tRNA genes, auxotrophic markers); (3) DNA segments that encode products which suppress the activity of a gene product; (4) DNA segments that encode products which can be readily identified (e.g., phenotypic markers such as beta-galactosidase, green fluorescent protein (GFP), and cell surface proteins); (5) DNA segments that bind products which are otherwise detrimental to cell survival and/or function; (6) DNA segments that otherwise inhibit the activity of any of the DNA segments described in Nos. 1-5 above (e.g., antisense oligonucleotides); (7) DNA segments that bind products that modify a substrate (e.g. restriction endonucleases); (8) DNA segments that can be used to isolate a desired molecule (e.g. specific protein binding sites); (9) DNA segments that encode a specific nucleotide sequence which can be otherwise non-functional (e.g., for PCR amplification of subpopulations of molecules); and/or (10) DNA segments, which when absent, directly or indirectly confer sensitivity to particular compounds.

Sequence identity can be determined by aligning sequences using algorithms, such as BESTFIT, FASTA, and TFASTA in the Wisconsin Genetics Software Package Release 7.0, Genetics Computer Group, 575 Science Dr., Madison, Wis.), using default gap parameters, or by inspection, and the best alignment (i.e., resulting in the highest percentage of sequence similarity over a comparison window). Percentage of sequence identity is calculated by comparing two optimally aligned sequences over a window of comparison, determining the number of positions at which the identical residues occurs in both sequences to yield the number of matched positions, dividing the number of matched positions by the total number of matched and mismatched positions not counting gaps in the window of comparison (i.e., the window size), and multiplying the result by 100 to yield the percentage of sequence identity. Unless otherwise indicated the window of comparison between two sequences is defined by the entire length of the shorter of the two sequences.

A "target nucleic acid" is a nucleic acid into which a transposon is to be inserted. Such a target can be part of a chromosome, episome or vector.

An "integration target sequence" or "target sequence" or "target site" for a transposase is a site or sequence in a target DNA molecule into which a transposon can be inserted by a transposase. The piggyBac transposase from *Trichoplusia ni* inserts its transposon predominantly into the target sequence 5'-TTAA-3'. PiggyBac-like transposases transpose their transposons using a cut-and-paste mechanism, which results in duplication of their 4 base pair target sequence on insertion into a DNA molecule. The target sequence is thus found on each side of an integrated piggyBac-like transposon.

The term "translation" refers to the process by which a polypeptide is synthesized by a ribosome 'reading' the sequence of a polynucleotide.

A 'transposase' is a polypeptide that catalyzes the excision of a corresponding transposon from a donor polynucleotide, for example a vector, and (providing the transposase is not integration-deficient) the subsequent integration of the transposon into a target nucleic acid. A "*Bombyx* transposase" means a transposase with at least 80% sequence identity to SEQ ID NO 407, including hyperactive variants of SEQ ID NO 407, that are able to transposase a corresponding transposon. A "*Xenopus* transposase" means a transposase with at least 80% sequence identity to SEQ ID NO 48, including hyperactive variants of SEQ ID NO 48, that are able, when fused to a heterologous nuclear localization sequence, to transposase a corresponding transposon.

The term "transposition" is used herein to mean the action of a transposase in excising a transposon from one polynucleotide and then integrating it, either into a different site in the same polynucleotide, or into a second polynucleotide.

The term "transposon" means a polynucleotide that can be excised from a first polynucleotide, for instance, a vector, and be integrated into a second position in the same polynucleotide, or into a second polynucleotide, for instance, the genomic or extrachromosomal DNA of a cell, by the action of a corresponding trans-acting transposase. A transposon comprises a first transposon end and a second transposon end, which are polynucleotide sequences recognized by and transposed by a transposase. A transposon usually further comprises a first polynucleotide sequence between the two transposon ends, such that the first polynucleotide sequence is transposed along with the two transposon ends by the action of the transposase. Natural transposons frequently comprise DNA encoding a transposase that acts on the transposon. Transposons of the present invention are "synthetic transposons" comprising a heterologous polynucleotide sequence which is transposable by virtue of its juxtaposition between two transposon ends.

The term "transposon end" means the cis-acting nucleotide sequences that are sufficient for recognition by and transposition by a corresponding transposase. Transposon ends of piggyBac-like transposons comprise perfect or imperfect repeats such that the respective repeats in the two transposon ends are reverse complements of each other. These are referred to as inverted terminal repeats (ITR) or terminal inverted repeats (TIR). A transposon end may or may not include additional sequence proximal to the ITR that promotes or augments transposition.

The term "vector" or "DNA vector" or "gene transfer vector" refers to a polynucleotide that is used to perform a "carrying" function for another polynucleotide. For example, vectors are often used to allow a polynucleotide to be propagated within a living cell, or to allow a polynucleotide to be packaged for delivery into a cell, or to allow a polynucleotide to be integrated into the genomic DNA of a cell. A vector may further comprise additional functional elements, for example it may comprise a transposon.

5.2 Description 5.2.1 Genomic Integration

Expression of a gene from a heterologous polynucleotide in a eukaryotic host cell can be improved if the heterologous polynucleotide is integrated into the genome of the host cell. Integration of a polynucleotide into the genome of a host cell also generally makes it stably heritable, by subjecting it to the same mechanisms that ensure the replication and division of genomic DNA. Such stable heritability is desirable for achieving good and consistent expression over long growth periods. For manufacturing of biomolecules, particularly for therapeutic applications, the stability of the host and consistency of expression levels is also important for regulatory purposes. Cells with gene transfer vectors, including transposon-based gene transfer vectors, integrated into their genomes are thus an important aspect of the invention.

Heterologous polynucleotides may be more efficiently integrated into a target genome if they are part of a transposon, for example so that they may be integrated by a transposase. A particular benefit of a transposon is that the entire polynucleotide between the transposon ITRs is integrated. This is in contrast to random integration, where a polynucleotide introduced into a eukaryotic cell is often fragmented at random in the cell, and only parts of the polynucleotide become incorporated into the target genome, usually at a low frequency. The piggyBac transposon from the looper moth *Trichoplusia ni* has been shown to be transposed by its transposase in cells from many organisms (see e.g. Keith et al (2008) BMC Molecular Biology 9:72 "Analysis of the piggyBac transposase reveals a functional nuclear targeting signal in the 94 c-terminal residues"). Heterologous polynucleotides incorporated into piggyBac-like transposons may be integrated into eukaryotic cells including animal cells, fungal cells or plant cells. Preferred animal cells can be vertebrate or invertebrate. Preferred vertebrate cells include cells from mammals including rodents such as rats, mice, and hamsters; ungulates, such as cows, goats or sheep; and swine. Preferred vertebrate cells also include cells from human tissues and human stem cells. Target cells types include lymphocytes, hepatocytes, neural cells, muscle cells, blood cells, embryonic stem cells, somatic stem cells, hematopoietic cells, embryos, zygotes and sperm cells (some of which are open to be manipulated in an in vitro setting). Preferred cells can be pluripotent cells (cells whose descendants can differentiate into several restricted cell types, such as hematopoietic stem cells or other stem cells) or totipotent cells (i.e., a cell whose descendants can become any cell type in an organism, e.g., embryonic stem cells). Preferred culture cells are Chinese hamster ovary (CHO) cells or Human embryonic kidney (HEK293) cells. Preferred fungal cells are yeast cells including *Saccharomyces cerevisiae* and *Pichia pastoris*. Preferred plant cells are algae, for example Chlorella, tobacco, maize and rice (Nishizawa-Yokoi et al (2014) Plant J. 77:454-63 "Precise marker excision system using an animal derived piggyBac transposon in plants").

Preferred gene transfer systems comprise a transposon in combination with a corresponding transposase protein that transposases the transposon, or a nucleic acid that encodes the corresponding transposase protein and is expressible in the target cell.

A transposase protein can be introduced into a cell as a protein or as a nucleic acid encoding the transposase, for example as a ribonucleic acid, including mRNA or any polynucleotide recognized by the translational machinery of a cell; as DNA, e.g. as extrachromosomal DNA including episomal DNA; as plasmid DNA, or as viral nucleic acid. Furthermore, the nucleic acid encoding the transposase protein can be transfected into a cell as a nucleic acid vector such as a plasmid, or as a gene expression vector, including a viral vector. The nucleic acid can be circular or linear. DNA encoding the transposase protein can be stably inserted into the genome of the cell or into a vector for constitutive or inducible expression. Where the transposase protein is transfected into the cell or inserted into the vector as DNA, the transposase encoding sequence is preferably operably linked to a heterologous promoter. There are a variety of promoters that could be used including constitutive promoters, tissue-specific promoters, inducible promoters, and the like. All DNA or RNA sequences encoding *Bombyx* or *Xenopus* transposase proteins are expressly contemplated. Alternatively, the transposase may be introduced into the cell directly as protein, for example using cell-penetrating peptides (e.g. as described in Ramsey and Flynn (2015) Pharmacol. Ther. 154: 78-86 "Cell-penetrating peptides transport therapeutics into cells"); using small molecules including salt plus propanebetaine (e.g. as described in Astolfo et al (2015) Cell 161: 674-690); or electroporation (e.g. as described in Morgan and Day (1995) Methods in Molecular Biology 48: 63-71 "The introduction of proteins into mammalian cells by electroporation").

It is possible to insert the transposon into DNA of a cell through non-homologous recombination through a variety of reproducible mechanisms, and even without the activity of a transposase. The transposons described herein can be used for gene transfer regardless of the mechanisms by which the genes are transferred.

5.2.2 *Xenopus*-Derived Piggybac-Like Transposons

Natural DNA transposons undergo a 'cut and paste' system of replication in which the transposon is excised from a first DNA molecule and inserted into a second DNA molecule. DNA transposons are characterized by inverted terminal repeats (ITRs) and are mobilized by an element-encoded transposase. The piggyBac transposon/transposase system is particularly useful because of the precision with which the transposon is integrated and excised (see for example "Fraser, M. J. (2001) The TTAA-Specific Family of Transposable Elements: Identification, Functional Characterization, and Utility for Transformation of Insects. Insect Transgenesis: Methods and Applications. A. M. Handler and A. A. James. Boca Raton, Fla., CRC Press: 249-268"; and "US 20070204356 A1: PiggyBac constructs in vertebrates" and references therein).

Many sequences with sequence similarity to the piggyBac transposase from *Trichoplusia ni* have been found in the genomes of phylogenetically distinct species from fungi to mammals, but very few have been shown to possess transposase activity (see for example Wu M, et al (2011) Genetica 139:149-54. "Cloning and characterization of piggyBac-like elements in lepidopteran insects", and references therein).

Excision activity has been identified in Txb transposases from *Xenopus* (Hikosaka et. al., Mol. Biol. Evol., 24(12): 2648-2656, 2007), but the authors reported no evidence for the integration of the excised target into the genome. This report suggested such transposases lack integration activity. However, surprisingly we have found that transposases originally identified in the genome of *Xenopus tropicalis* (SEQ ID NOS 48 and 49) are transpositionally active in mammalian cells when fused to a heterologous nuclear localization signal. In the absence of a fused nuclear localization signal, the naturally occurring *Xenopus* transposases are essentially inactive for genomic integration (see Example 6.1.1 and Table 1). Our discovery reveals why Hirosaka failed to see integration: the experiments performed by Hikosaka et. al. involved transfecting a DNA target and DNA encoding a transposase into mammalian cells. The transposase, produced in the cytoplasm, would be able to act on transfected DNA in the cytoplasm to excise the transposon. However, no genomic integration activity would be detected if the transposase, which lacked an NLS, remained cytoplasmic.

Here we have identified transposon ends including ITRs that, when added to the ends of a heterologous polynucleotide sequence, create a synthetic *Xenopus* transposon which is efficiently integrated into genomic DNA by a *Xenopus* transposase. A left target sequence followed by a left transposon end sequence comprising a sequence selected from SEQ ID NO: 1-8 is added to on one side of a heterologous polynucleotide. A right transposon end sequence comprising a sequence selected from SEQ ID NO: 12-16, and followed by a right target sequence is added to the other side of the heterologous polynucleotide. The resulting polynucleotide is a synthetic *Xenopus* transposon, and is efficiently transposed by transposases selected from SEQ ID NO: 48 or 49, fused to a heterologous nuclear localization signal. See Tables 1-3 and Examples 6.1.1, 6.1.2.1 and 6.1.2.2.

*Xenopus* transposases recognize synthetic *Xenopus* transposons. They excise the transposon from a first DNA molecule, by cutting the DNA at the target sequence at the left end of one transposon end and the target sequence at the right end of the second transposon end, re-join the cut ends of the first DNA molecule to leave a single copy of the target sequence. The excised transposon sequence, including any heterologous DNA that is between the transposon ends, is integrated by the transposase into a target sequence of a second DNA molecule, such as the genome of a target cell.

These *Xenopus* left and right transposon ends share a 14 bp almost perfectly repeated sequence inverted in orientation in the two ends: (5'-CCYTTTBMCTGCCA: SEQ ID NO: 19) adjacent to the target sequence. Here and elsewhere when inverted repeats are defined by a sequence including a nucleotide defined by an ambiguity code, the identity of that nucleotide can be selected independently in the two repeats. The near-perfect conservation of this 14 bp ITR sequence at both ends of the *Xenopus* transposon allow us to identify it as the transposon ITR. Transposons comprising a heterologous polynucleotide inserted between two transposon ends, each comprising SEQ ID NO: 19 in inverted orientations in the two transposon ends, and flanked by a target sequence, can be transposed from one DNA molecule to another, by their corresponding *Xenopus* transposases. Naturally occurring *Xenopus* transposases (SEQ ID NO: 48 and 49) must be fused to a heterologous nuclear localization signal to effect this transposition.

Truncated and modified versions of naturally occurring left and right transposon ends will function as part of a synthetic *Xenopus* transposons. For example, as shown in Example 6.1.2.2 and Tables 2 and 3, a left transposon end consisting of a target sequence followed by a sequence selected from SEQ ID NO: 4-7, and a right transposon end consisting of a sequence selected from SEQ ID NO: 13-16 followed by a target sequence contains all sequences necessary for transposition of DNA by a *Xenopus* transposase fused to a heterologous nuclear localization signal. We observed that sequence differences are tolerated within the truncated transposon ends in addition to the degeneracies noted in the ITR sequences. For example, left transposon end SEQ ID NO: 7 consists of SEQ ID NO: 9 in addition to the ITR, while left transposon end SEQ ID NO: 5 consists of SEQ ID NO: 10 in addition to the ITR. Similarly, right transposon end SEQ ID NO: 16 consists of SEQ ID NO: 17 in addition to the ITR, while right transposon end SEQ ID NO: 13 consists of SEQ ID NO: 18 in addition to the ITR.

A *Xenopus* transposon can comprise a heterologous polynucleotide flanked by two transposon ends, wherein one transposon end comprises a sequence that is at least 90% identical or at least 95% identical or at least 99% identical to SEQ ID NO: 7 and one transposon end comprises a sequence that is at least 90% identical or at least 95% identical or at least 99% identical to SEQ ID NO: 16.

A *Xenopus* transposon can comprise a heterologous polynucleotide flanked by two transposon ends, wherein one transposon end comprises at least 14 or at least 16 or at least 18 or at least 20 or at least 25 contiguous bases from SEQ ID NO: 7 and one transposon end comprises at least 14, or at least 16, or at least 18, or at least 20 contiguous bases from SEQ ID NO: 16.

A *Xenopus* transposon can comprise a heterologous polynucleotide flanked by two transposon ends wherein each transposon end comprises the sequence 5'-CCYTTTBMCT-GCCA-3' (SEQ ID NO: 19) inverted in orientation in the two transposon ends. One end of this *Xenopus* transposon may further comprise at least 14, or at least 16, or at least 18, or at least 20 contiguous bases from SEQ ID NO: 9 and the other end may further comprise at least 14 or at least 16 or at least 18 or at least 20 or at least 25 contiguous bases from SEQ ID NO: 17.

*Xenopus* transposons are transposable by *Xenopus* transposases, for example by at least one polypeptide selected from SEQ ID NO: 48, 49 or 52-402 and fused to a heterologous nuclear localization signal. Operability of a *Xenopus* transposon can be shown by the ability of a transposase having the amino acid sequence of SEQ ID NO:61 fused to a heterologous NLS to transpose the transposon.

Cells whose genomes contain a *Xenopus* transposon are an aspect of the invention. The cell may be any eukaryotic cell.

5.2.3 *Bombyx*-Derived Piggybac-Like Transposons

A transposon was identified from the genome of *Bombyx mori* with the functional transposon ends being contained within SEQ ID NO: 23 and SEQ ID NO: 29. A transposase that can recognize and transpose a transposon comprising these transposon ends is SEQ ID NO: 407. The inverted terminal repeats (ITRs) at the ends of the natural transposon comprising SEQ ID NOS: 23 and 29 were not flanked by the canonical 5'-TTAA-3' target sequence usually observed for transposons with significant sequence identity to *Trichoplusia ni* piggyBac; they were flanked by 5'-TTAT-3' sequences adjacent to the ITRs.

Here we have identified transposon ends including ITRs that can be added to the ends of a heterologous polynucleotide sequence to effect the efficient integration of the polynucleotide into genomic DNA by the action of a *Bombyx* transposase. A left target sequence followed by a left transposon end sequence comprising a sequence selected from SEQ ID NO: 23-27 is added to on one side of a heterologous polynucleotide. A right transposon end sequence comprising a sequence selected from SEQ ID NO: 29-32, followed by a right target sequence is added to the other side of the heterologous polynucleotide. The resulting polynucleotide is a synthetic *Bombyx* transposon, and is efficiently transposed by transposase SEQ ID NO: 407, whether or not fused to a heterologous nuclear localization signal. See Tables 1 and 2 and Examples 6.1.1 and 6.1.2.1.

*Bombyx* transposases recognize synthetic *Bombyx* transposons. They excise the transposon from a first DNA molecule, by cutting the DNA at the target sequence at the left end of one transposon end and the target sequence at the right end of the second transposon end, re-join the cut ends of the first DNA molecule to leave a single copy of the target sequence. The excised transposon sequence, including any heterologous DNA that is between the transposon ends, is integrated into a target sequence of a second DNA molecule, such as the genome of a target cell.

The left and right *Bombyx* transposon ends share a 16 bp repeat sequence at their ends (5'-CCCGGCGAGCATGAGG-3': SEQ ID NO: 33) inverted in orientation in the two ends immediately adjacent to the target sequence. That is the left transposon end begins with the sequence 5'-CCCGGCGAGCATGAGG-3' (SEQ ID NO: 33), and the right transposon ends with the reverse complement of this sequence: 5'-CCTCATGCTCGCCGGG-3' (SEQ ID NO: 34). The perfect conservation of this 16 bp sequence at both ends of the transposon allowed us to identify it as the transposon ITR.

The degeneracy observed for the *Xenopus* piggyBac-like transposon described in Section 5.2.2 suggests that this sequence is not completely immutable, but may accept one or two or three nucleotide changes from the consensus (as described for SEQ ID NO: 19), providing functional *Bombyx* ITRs with 93%, 87% or 81% sequence identity with SEQ ID NO: 33 (or (SEQ ID NO: 34) respectively. A *Bombyx* transposon can comprise a heterologous polynucleotide inserted between a left and right transposon end, wherein each transposon end comprises a sequence at least 81% identical or at least 87% identical or at least 93% identical to the sequence 5'-CCCGGCGAGCATGAGG-3' (SEQ ID NO: 33) at one end, a sequence at least 81% identical or at least 87% identical or at least 93% identical to the sequence 5'-CCTCATGCTCGCCGGG-3' (SEQ ID NO: 34) at the other end.

Truncated and modified versions of the left and right transposon ends also function as part of a synthetic *Bombyx* transposon. For example, as shown in Example 6.1.2.1 and Table 2, a target sequence followed by a left transposon end comprising a sequence selected from SEQ ID NO: 23-25, and a right transposon end comprising SEQ ID NO: 29 or 31, followed by a target sequence, contains all sequences necessary for transposition of by a *Bombyx* transposase.

A *Bombyx* transposon can comprise a heterologous polynucleotide flanked by two transposon ends wherein one transposon end comprises a sequence that is at least 90% or at least 95% identical or at least 99% identical to SEQ ID NO: 25 and one transposon end comprises a sequence that is at least 90% identical or at least 95% or at least 99% identical to SEQ ID NO: 31.

A *Bombyx* transposon can comprise a heterologous polynucleotide flanked by two transposon ends, wherein one transposon end comprises at least 14 or at least 16 or at least 18 or at least 20 contiguous bases from SEQ ID NO: 25 and one transposon end comprises at least 14 or at least 16 or at least 18 or at least 20 contiguous bases from SEQ ID NO: 31.

A *Bombyx* transposon can comprise a heterologous polynucleotide flanked by two transposon ends wherein each transposon end comprises a sequence that is at least 81% identical or at least 87% identical or at least 93% identical to the sequence 5'-CCCGGCGAGCATGAGG-3' (SEQ ID NO: 33) inverted in orientation in the two transposon ends. One end of this *Bombyx* transposon may further comprise at least 14, or at least 16, or at least 18, or at least 20 contiguous bases from SEQ ID NO: 27 and the other end may further comprise at least 14 or at least 16 or at least 18 or at least 20 contiguous bases from SEQ ID NO: 32.

*Bombyx* transposons are transposable by *Bombyx* transposases, for example by at least one polypeptide selected from SEQ ID NO: 407, or 412-697, optionally fused to a heterologous nuclear localization signal. Operability of a *Bombyx* transposon can be shown by the ability of a transposase having the amino acid sequence of SEQ ID NO:415 fused to a heterologous NLS to transpose the transposon.

Cells whose genomes contain a *Bombyx* transposon are an aspect of the invention. The cell may be any eukaryotic cell.

5.2.4 Modified Transposon Target Sequences

Having observed that the natural *Bombyx* and *Xenopus* transposons were flanked by different target sequences (5'-TTAT-3' and 5'TTAA-3' respectively), we attempted to modify the target sequences of piggyBac-like transposons by changing the sequence adjacent to the ITR. This is expected to change the 5' overhangs of the excised transposon (Mitra et al., 2008. EMBO J. 27: 1097-1109 "piggyBac can bypass DNA synthesis during cut and paste transposition"). We created a piggyBac-TTAT transposon by joining a 5'-TTAT-3' target sequence to piggyBac left transposon end SEQ ID NO 37 and placing this on one side of reporter construct SEQ ID NO 39, and joining piggyBac right transposon end SEQ ID NO 38 followed by target sequence 5'-TTAT-3' to the other side. We observed that in vivo in mammalian cells, the TTAT piggyBac transposon was integrated by the piggyBac transposase (SEQ ID NO. 698) to give expression of the protein encoded on the transposon at comparable levels to the TTAA piggyBac transposon (see Section 6.1.2 and compare Table 2 rows 24 and 26).

We made a similar switch from 5'-TTAA-3' to 5'-TTAT-3' target sequence for the *Xenopus* transposon. Again we observed that in vivo in mammalian cells, the TTAT *Xenopus* transposon was integrated by a *Xenopus* transposase fused to a heterologous nuclear localization signal, to give expression of the protein encoded on the transposon at comparable levels to those from the TTAA *Xenopus* transposon integrated by the same transposase (see Section 6.1.2 and compare Table 2 rows 14 and 22). Thus a *Xenopus* transposase is effective at transposing transposons with different target sequences including 5'-TTAT-3' and 5'-TTAA-3' target sequences.

Finally, we also made the reverse switch for the *Bombyx* transposon, changing its target sequence to TTAA. We observed that in vivo in mammalian cells, the TTAA *Bombyx* transposon was integrated by a *Bombyx* transposase, to give expression of the protein encoded on the transposon at comparable levels to those from the TTAT *Bombyx* transposon integrated by the same transposase (see Section 6.1.2 and compare Table 2 rows 3 and 11). Thus a *Bombyx* transposase is effective at transposing transposons with different target sequences including 5'-TTAT-3' and 5'-TTAA-3' target sequences.

In all cases of piggyBac-like transposons we tested (*Trichoplusi ni, Bombyx* and *Xenopus*), the transposases excised their transposons precisely from the DNA in which they were originally present, leaving a single copy of the 5'-TTAA-3' or 5'-TTAT-3' target sequence that was initially present adjacent to each of the transposon ITRs. The precise excision of all of these transposons by their transposases is consistent with the cut and paste mechanism described for *Trichoplusi ni* piggyBac.

*Bombyx* transposase SEQ ID NO 407 shares 36% sequence identity with the piggyBac transposase from *Trichoplusia ni; Xenopus* transposases SEQ ID NO 48 and 49 share only 23% sequence identity with the piggyBac transposase from *Trichoplusia ni; Xenopus* transposases SEQ ID NO: 48 and 49 share only 22% sequence identity with *Bombyx* transposase SEQ ID NO: 407. All 3 of these transposases are able to efficiently transpose their transposons when the target sequence on the transposon is switched between 5'-TTAA-3' and 5'-TTAT-3' or vice versa. These data provide evidence the target sequence for any piggyBac-like transposon can be switched from 5'-TTAA-3' to 5'-TTAT-3' just by changing the target sequence flanking the transposon ITRs. A transposon with modified target sequences can be created for active transposases with at least 23% sequence identity to the piggyBac transposase from *Trichoplusia ni* (SEQ ID NO: 698), or 22% sequence identity with *Bombyx* transposase SEQ ID NO: 407, or 22% sequence identity with *Xenopus* transposases SEQ ID NOS: 48 or 49, as identified using the TBLASTN algorithm, by taking functional left and right transposon ends and changing the target sequences adjacent to the ITRs from 5'-TTAA-3' to 5'-TTAT-3'.

Efficient integration into 5'-TTAT-3'/5'-ATAA-3' target sequences can be advantageous, because 5'-TTAT-3' is a reverse complement of 5'-ATAA-3' which is part of the canonical mammalian polyA signal 5'-aATAAa-3'. Thus the 5'-TTAT-3' insertion site targeted by the TTAT-directed transposon occurs at almost every polyA signal. PolyA signals are associated with transcriptionally active regions of the chromosome. Thus transposons that insert at 5'-TTAT-3' sites, including *Bombyx* transposons and modified *Xenopus* and piggyBac transposons, are likely to yield higher expression levels of the genes they carry than transposons that insert at 5'-TTAA-3' sites. This effect may become more pronounced with time, since naturally transcriptionally active regions may be more resistant to silencing effects.

Other useable target sequences for piggyBac transposons are 5'-CTAA-3', 5'-TTAG-3', 5'-ATAA-3', 5'-TCAA-3', 5'-AGTT-3', 5'-ATTA-3', 5'-GTTA-3', 5'-TTGA-3', 5'-TTTA-3', 5'-TTAC-3', 5'-ACTA-3', 5'-AGGG-3', 5'-CTAG-3', 5'-GTAA-3', 5'-AGGT-3', 5'-ATCA-3', 5'-CTCC-3', 5'-TAAA-3', 5'-TCTC-3', 5'-TACA-3', 5'-AAAT-3', 5'-AATC-3', 5'-ACAA-3', 5'-ACAT-3', 5'-ACTC-3', 5'-AGTG-3', 5'-ATAG-3', 5'-CAAA-3', 5'-CACA-3', 5'-CATA-3', 5'-CCAG-3', 5'-CCCA-3', 5'-CGTA-3', 5'-CTGA-3', 5'-GTCC-3', 5'-TAAG-3', 5'-TCTA-3', 5'-TGAG-3', 5'-TGTT-3', 5'-TTCA-3', 5'-TTCT-3' and 5'-TTTT-3' (Li et al., 2013. Proc. Natl. Acad. Sci vol. 110, no. 6, E478-487). This suggests that a synthetic piggyBac-like transposon can be created by using a repeat of one of these sequences in place of the natural 5'-TTAA-3' or 5'-TTAT-3' target sequence flanking the transposon ITRs. For example, a *Bombyx* transposon comprises a first useable target sequence, ITR sequence SEQ ID NO: 33, a heterologous polynucleotide, a second ITR sequence SEQ ID NO: 33 inverted in orientation relative to the first, and a second useable target sequence, where the first and second useable target sequences are preferably the same. A *Xenopus* transposon comprises a first useable target sequence, ITR sequence SEQ ID NO: 19, a heterologous polynucleotide, a second ITR sequence SEQ ID NO: 19 inverted in orientation relative to the first, and a second useable target sequence, where the first and second useable target sequences are preferably the same. Cells whose genomes contain *Xenopus* or *Bombyx* transposons are an aspect of the invention.

5.2.5 Selection Systems for Modifying Piggybac-Like Transposases

Two properties of transposases that are of particular interest for genomic modifications are their ability to integrate a polynucleotide into a target genome, and their ability to precisely excise a polynucleotide from a target genome. Both of these can be selected for with a suitable system.

A system for selecting for the first step of transposition, which is excision of a transposon from a first polynucleotide, comprises the following components: (i) A first polynucleotide encoding a first selectable marker operably linked to sequences that cause it to be expressed in a selection host and (ii) A first transposon comprising transposon ends recognized by the first transposase. The first transposon is present in, and interrupts the coding sequence of, the first selectable marker, such that the first selectable marker is not active. The first transposon is placed in the first selectable marker such that precise excision of the first transposon causes the first selectable marker to be reconstituted. Host cells that contain the first polynucleotide, either chromosomally or extrachromosomally, can be used to screen for transposases that can excise the first transposon.

If the first transposon comprises a second selectable marker, operably linked to sequences that make the second selectable marker expressible in the selection host, transposition of the second selectable marker into the genome of the host cell will yield a genome comprising active first and second selectable markers. The cell will therefore grow under selective conditions for both markers. The second selectable marker, like the first selectable marker, may be a gene encoding an antibiotic resistance gene, or an auxotrophic marker, or any other selectable marker.

If the first transposon comprises a first counter-selectable marker, operably linked to sequences that make the first counter-selectable marker expressible in the selection host, transposition of the first counter-selectable marker into the genome of the host cell will yield a cell with an active first selectable marker and active first counter-selectable marker. The cell will therefore die under restrictive conditions for the first counter-selectable marker.

These two selection schemes may be combined by using a second selectable marker that is also a first counter-selectable marker. Examples of such markers include auxotrophic marker genes in the uracil or tryptophan synthetic pathways. These genes may be selected for by culturing cells in the absence of the nutrient, in this case uracil or tryptophan respectively. Biosynthetic genes may also act as counter-selectable markers if they enable a cell to incorporate a toxic analog in place of a genuine metabolic precursor into their molecules. Genes in the uracil biosynthetic pathway can convert the non-toxic compound 5-fluoroorotic acid into toxic 5-fluorouracil, thus growing cells with 5-fluoroorotic acid is restrictive for a functional uracil pathway. Similarly, 5-fluoroanthranilic acid is converted by the tryptophan synthesis pathway to the toxic 5-fluorotryptophan, thus growing cells with 5-fluoroanthranilic acid is restrictive for a functional tryptophan pathway. Host cells that contain a first polynucleotide comprising a first selectable marker interrupted by a transposon comprising a uracil or tryptophan gene, can be used to screen simultaneously for hyperactive and integration-deficient transposases. For example, a polynucleotide expressible in the host cell encoding a first transposase or a first transposase library such as a site saturation mutagenesis library for one or more amino acid positions is introduced into host cells containing the first polynucleotide. These cells are the divided into two pools. The first pool is cultured under conditions that are selective for the first selectable marker and restrictive for the first counter-selectable marker. The genes encoding the transposases are then isolated from the host cells that gained the ability to grow, and transposase genes from this first pool of cells may be analyzed to identify amino acid changes that enhance excision activity but not integration activity. The second pool is cultured under conditions that are selective for the first selectable marker and for the second selectable marker. The genes encoding the transposases are then isolated from the host cells that gained the ability to grow, and transposase genes from this second pool of cells may be analyzed to identify amino acid changes that enhance the complete transposase activity.

These selection systems may be used to identify transposases with modified activities by screening libraries of variant transposases. One type of library is a pool of polynucleotides encoding all possible amino acid substitutions at a first amino acid position in the transposase. A site-saturation mutagenesis library at a single position encodes twenty different polypeptides, including one that is the natural transposase sequence. For a transposase that is 600 amino acids long, all possible single amino acid substitutions are present in 600 such site-saturation mutagenesis libraries, one for each position. These libraries can be tested using a transposase selection system to identify active substitutions at each position.

Individual favorable mutations may be combined in a variety of different ways, for example by "DNA shuffling" or by methods described in U.S. Pat. No. 8,635,029 B2. A transposase with modified activity, either for activity on a new target sequence including a 5'-TTAT-3' target sequence, or increased activity on an existing target sequence may be obtained by using variations of the selection scheme outlined above with an appropriate corresponding transposon.

Activity of transposases may also be increased by fusion of nuclear localization signal (NLS) at the N-terminus, C-terminus, both at the N- and C-termini or internal regions of the transposase protein, as long as transposase activity is retained. A nuclear localization signal or sequence (NLS) is an amino acid sequence that 'tags' or facilitates interaction of a protein, either directly or indirectly with nuclear transport proteins for import into the cell nucleus. Nuclear localization signals (NLS) used can include consensus NLS sequences, viral NLS sequences, cellular NLS sequences, and combinations thereof.

Transposases may also be fused to other protein functional domains. Such protein functional domains can include DNA binding domains, flexible hinge regions that can facilitate one or more domain fusions, and combinations thereof. Fusions can be made either to the N-terminus, C-terminus, or internal regions of the transposase protein so long as transposase activity is retained. DNA binding domains used can include a helix-turn-helix domain, Zn-finger domain, a leucine zipper domain, or a helix-loop-helix domain. Specific DNA binding domains used can include a Gal4 DNA binding domain, a LexA DNA binding domain, or a Zif268 DNA binding domain. Flexible hinge regions used can include glycine/serine linkers and variants thereof.

A comparable process may be used to increase the transposability of the transposon ends by a transposase. In this case, the transposon may comprise a first active selectable marker. Transposon ends may be selected from any piggyBac-like transposon. The sequence of one or both transposon ends may be subjected to random or pre-determined sequence changes, including changes to the target sequence, the ITR or to other parts of the transposon ends. The transposon may then be introduced into a first cell that contains a target polynucleotide comprising a second active selectable marker and an active transposase. If the transposase is able to transpose the transposon, some fraction of the transposons will be transposed into the target polynucleotide. The target polynucleotide is purified from the first cell, and introduced into a second cell which is subjected to restrictive conditions for which it requires the first selectable marker and the second selectable marker to survive. The transposon may be recovered, for example by sequencing out from the transposon to identify the flanking sequence, and then amplifying the transposon using PCR. The process may be performed in pools of variants: a more active transposon will create target polynucleotides containing both selectable markers more frequently, and will thus be more highly represented in the population. In this process, the transposon may optionally be present as a reversible interruption in a selectable marker as described for the transposase activity screen. However, this is not necessary for the transposon activity screen, since the transposed transposons are detected directly.

5.2.6 Modified *Xenopus* Transposases

We subjected *Xenopus* transposase SEQ ID NO: 48 to saturation mutagenesis as described in Example 6.3.1.1, and identified 1,793 (16.0%) amino acid substitutions that were associated with increased transposition activity (a composite measure of integration and excision), and 1,074 (9.6%) amino acid substitutions that were associated with increased excision activity, out of a total of 11,172 possible substitutions (19 possible substitutions at each of the 588 amino acids excluding the invariant N-terminal methionine). The two classes of substitutions had some overlap but were neither identical nor did one class completely contain the other. These beneficial substitutions are shown in Table 4 columns C and D.

A similar number of substitutions were found to be essentially neutral as to effect on transposition or excision activity: that is, they were present at approximately the same frequency in unselected and post-selection libraries. Thus *Xenopus* transposases readily accept many amino acid substitutions without significant functional detriment.

*Xenopus* transposases can thus be created that are not naturally occurring sequences, (e.g. not SEQ ID NO: 48 or 49), but that are at least 99% identical, or at least 98% identical, or at least 97% identical, or at least 96% identical, or at least 95% identical, or at least 90% identical, or at least 84% identical to SEQ ID NO 48. Such variants can retain partial activity of the transposase of SEQ ID NO:48 (as determined by either or both of transposition and/or excision activity), can be functionally equivalent of the transposase of SEQ ID NO:48 in either or both of transposition and excision, or can have enhanced activity relative to the transposase of SEQ ID NO:48 in transposition, excision activity or both. Such variants can include mutations shown herein to increase transposition and/or excision, mutations shown herein to be neutral as to transposition and/or excision, and mutations detrimental to transposition and/or integration or any combination of such mutations. Preferred variants include mutations shown to be neutral or to enhance transposition/and or excision. Some such variants lack mutations shown to be detrimental to transposition and/or excision. Some such variants include only mutations shown to enhance transposition, only mutations shown to enhance excision, or mutations shown to enhance both transposition and excision.

Enhanced activity means activity (e.g., transposition or excision activity) that is greater beyond experimental error than that of a reference transposase from which a variant was derived. The activity can be greater by a factor of e.g., 1.5, 2, 5, 10, 20, 50 or 100 fold of the reference transposase. The enhanced activity can lie within a range of for example 2-100 fold, 2-50 fold, 5-50 fold or 2-10 fold of the reference transposase. Here and elsewhere activities can be measured as demonstrated in the examples.

Functional equivalence means a variant transposase can mediate transposition and/or excision of the same transposon with a comparable efficiency (within experimental error) to a reference transposase. More than 80 representative sequences of variant *Xenopus* transposases with transposition frequencies comparable to naturally occurring *Xenopus* transposase SEQ ID NO 48 are SEQ ID NOs: 325-402.

Furthermore, variant sequences of SEQ ID NO 48 can be created by combining two, or three or four, or five or more substitutions selected from Table 4 column C or D. Combining beneficial substitutions, for example those shown in column C or D of Table 4 can result in hyperactive variants of SEQ ID NO 48. Such variants may be created in a library, for example by DNA shuffling, and then identified by selection using a scheme as outlined in Section 5.2.5 or Example 6.3.1. Alternatively, methods described in U.S. Pat. No. 8,635,029 can be used to design, synthesize and test small numbers of variants incorporating amino acid substitutions to obtain transposases with improved integration or excision activities.

*Xenopus* transposase variants that are hyperactive for integration in yeast and mammalian cells were prepared as described in Example 6.3.1.1. We identified at least 25 *Xenopus* transposases (SEQ ID NOs: 52-76) with transposition frequencies about at least 50-fold greater than that of naturally occurring *Xenopus* transposase SEQ ID NO: 48. We identified more than 130 *Xenopus* transposases (SEQ ID NOs: 77-210) with transposition frequencies between about 10-fold greater and 50-fold greater than that of naturally occurring *Xenopus* transposase SEQ ID NO: 48. We identified more than 100 *Xenopus* transposases (SEQ ID NOs: 211-324) with transposition frequencies between about 2-fold greater and 10-fold greater than that of naturally occurring *Xenopus* transposase SEQ ID NO: 48. These transposases comprised one or more of the substitutions (relative to SEQ ID NO: 48) listed in Table 4 columns C and D. Preferred hyperactive *Xenopus* transposases comprised one or more of the substitutions (relative to SEQ ID NO: 48) listed in Table 11 column C. Preferred hyperactive *Xenopus* transposases include polypeptides comprising one of SEQ ID NOS: 52-402; some hyperactive transposases may further comprise a heterologous nuclear localization sequence.

Preferred hyperactive *Xenopus* transposases comprise an amino acid sequence, other than a naturally occurring protein (e.g., not a transposase whose amino acid sequence comprises SEQ ID NO:48 or 49), that is at least 85% identical or at least 90% identical or at least 95% identical, or at least 99% identical to the amino acid sequence of any of SEQ ID NOs: 51-406, including SEQ ID NO: 61. Some preferred hyperactive transposases comprise an amino acid sequence, other than a naturally occurring protein, that is at least 85% identical or at least 90% identical or at least 95% identical, or at least 99% identical to the amino acid sequence of SEQ ID NO: 61 and that comprises at least one amino acid substitution (relative to SEQ ID NO: 48) shown in Table 4 column C, Table 4 column D or Table 11 column C. Preferred hyperactive *Xenopus* transposases include polypeptides comprising an amino acid substitution at a position selected from amino acid 6, 7, 16, 19, 20, 21, 22, 23, 24, 26, 28, 31, 34, 67, 73, 76, 77, 88, 91, 141, 145, 146, 148, 150, 157, 162, 179, 182, 189, 192, 193, 196, 198, 200, 210, 212, 218, 248, 263, 270, 294, 297, 308, 310, 333, 336, 354, 357, 358, 359, 377, 423, 426, 428, 438, 447, 447, 450, 462, 469, 472, 498, 502, 517, 520, 523, 533, 534, 576, 577, 582, 583 or 587 (relative to SEQ ID NO: 48). Preferred hyperactive *Xenopus* transposases include polypeptides comprising an amino acid substitution, relative to SEQ ID NO: 48, selected from Y6C, S7G, M16S, S19G, S20Q, S20G, S20D, E21D, E22Q, F23T, F23P, S24Y, S26V, S28Q, V31K, A34E, L67A, G73H, A76V, D77N, P88A, N91D, Y141Q, Y141A, N145E, N145V, P146T, P146V, P146K, P148T, P148H, Y150G, Y150S, Y150C, H157Y, A162C, A179K, L182I, L182V, T189G, L192H, S193N, S193K, V196I, S198G, T200W, L210H, F212N, N218E, A248N, L263M, Q270L, S294T, T297M, S308R, L310R, L333M, Q336M, A354H, C357V, L358F, D359N, L377I, V423H, P426K, K428R, S438A, T447G, T447A, L450V, A462H, A462Q, I469V, I472L, Q498M, L502V, E517I, P520D, P520G, N523S, I533E, D534A, F576R, F576E, K577I, I582R, Y583F, L587Y or L587W, or any combination thereof including at least 1, 2, 3, 4, 5, 6, 7, 8, 9, 10 or all of these mutations.

*Xenopus* transposase variants that are active for excision but deficient in integration in yeast and mammalian cells were prepared as described in Example 6.3.1.1. Preferred integration-deficient *Xenopus* transposase sequences include SEQ ID NOS: 51 and 403-406; these integration deficient *Xenopus* transposases may further comprise a heterologous nuclear localization sequence. Preferred integration-deficient *Xenopus* transposases comprise an amino acid sequence, other than a naturally occurring protein, that is 90% identical to the amino acid sequence of SEQ ID NO 405. Some preferred integration-deficient transposases comprise an amino acid sequence, other than a naturally occurring protein, that comprises an amino acid substitution (relative to SEQ ID NO 48) wherein the Asn at amino acid position 218 is replaced with a Glu or an Asp residue (N218D or N218E).

Methods of creating transgenic cells using hyperactive *Xenopus* transposases are an aspect of the invention. A method of creating a transgenic cell comprises (i) introducing into a eukaryotic cell a hyperactive *Xenopus* transposase (as a protein or as a polynucleotide encoding the transposase) and a corresponding *Xenopus* transposon; (ii) identifying a cell in which a *Xenopus* transposon is incorporated into the genome of the eukaryotic cell. Identifying the cell in which a *Xenopus* transposon is incorporated into the genome of the eukaryotic cell may comprise selecting the eukaryotic cell for a selectable marker encoded on the *Xenopus* transposon. The selectable marker may be any selectable polypeptide, including any described herein.

5.2.7 Modified *Bombyx* Transposases

We subjected *Bombyx* transposase SEQ ID NO 407 to saturation mutagenesis as described in Example 6.3.1, and identified 1,176 amino acid substitutions (10.1%) that were associated with increased transposition activity, and 1,044 (9.0%) amino acid substitutions that were associated with increased excision activity, out of a total of 11,571 possible substitutions (19 possible substitutions at each of the 609 amino acids excluding the invariant N-terminal methionine). The two classes of substitutions had some overlap but were neither identical nor did one class completely contain the other. These beneficial substitutions are shown in Table 4 columns G and H.

A similar number of substitutions were found to be essentially neutral as to transposition or excision activity: that is, they were present at approximately the same frequency in unselected and post-selection libraries. Thus *Bombyx* transposases readily accept many amino acid substitutions without significant functional detriment. Transposases can thus be created that are not naturally occurring sequences, e.g., not *Bombyx* transposase SEQ ID NO 407, but that are at least 99% identical, or at least 98% identical, or at least 97% identical, or at least 96% identical, or at least 95% identical, or at least 90% identical, or at least 84% identical to SEQ ID NO 407 (but do not comprise SEQ ID NO:407 per se).

Such variants can retain partial activity of the transposase of SEQ ID NO:407 (transposition and/or excision activity), can be functionally equivalent of the transposase of SEQ ID NO:407 in either or both of transposition and excision activity, or can have enhanced activity relative to the transposase of SEQ ID NO:407 in transposition, excision activity or both. Such variants can include mutations shown herein to increase transposition and/or excision, mutations shown herein to be neutral as to transposition and/or excision, and mutations detrimental to transposition and/or integration or any combination of such mutations. Preferred variants include mutations shown to be neutral or enhancing of transposition/and or excision. Some such variants lack mutations shown to be detrimental to transposition and/or excision. Some such variants include only mutations shown to enhance transposition, only mutations shown to enhance excision, or mutations shown to enhance both transposition and excision Enhanced activity means activity that is greater beyond experimental error of that of a reference transposase from which a variant was derived. The activity can be greater by a factor of e.g., 1.5, 2, 5, 10, 20, 50 or 100 fold of the reference transposase. The enhanced activity can lie within a range of for example 2-100 fold, 2-50 fold, 5-50 fold or 2-10 fold of the reference transposase. Here and elsewhere activities can be measured as demonstrated in the examples.

More than 60 representative sequences of variant *Bombyx* transposases with transposition frequencies comparable to naturally occurring *Bombyx* transposase SEQ ID NO 407 are SEQ ID NOs: 634-697.

Furthermore, variant sequences of SEQ ID NO: 407 can be created by combining two, or three or four, or five or more substitutions shown in Table 4 columns G and H. Combining beneficial substitutions, for example those shown in column G or H of Table 4 can result in hyperactive variants of SEQ ID NO: 407. Such variants may be created in a library, for example by DNA shuffling, and then identified by selection using a scheme as outlined in Section 5.2.5 or Example 6.3.1.

*Bombyx* transposase variants that are hyperactive for integration in yeast and mammalian cells were prepared as described in Example 6.3.2.1. Many hyperactive transposases were obtained. We identified at least 20 *Bombyx* transposases (SEQ ID NOs: 412-431) with transposition frequencies about at least 50-fold greater than that of naturally occurring *Bombyx* transposase SEQ ID NO: 407. We identified more than 90 *Bombyx* transposases (SEQ ID NOs: 432-524) with transposition frequencies between about 10-fold greater and 50-fold greater than that of naturally occurring *Bombyx* transposase SEQ ID NO: 407. We identified more than 100 *Bombyx* transposases (SEQ ID NOs: 525-633) with transposition frequencies between about 2-fold greater and 10-fold greater than that of naturally occurring *Bombyx* transposase SEQ ID NO: 407. These transposases comprised one or more of the substitutions (relative to SEQ ID NO: 407) listed in Table 4 columns G and H. Preferred hyperactive *Bombyx* transposases comprise one or more of the substitutions (relative to SEQ ID NO: 407) listed in Table 4 columns G and H or Table 11 column H. Preferred hyperactive *Bombyx* transposases include polypeptides comprising one of SEQ ID NOS: 412-524; these hyperactive transposases may further comprise a heterologous nuclear localization sequence. Preferred hyperactive transposases comprise an amino acid sequence, other than a naturally occurring protein, that is at least 85% identical or at least 90% identical or at least 95% identical, or at least 99% identical to the amino acid sequence of SEQ ID NO: 415. Preferred hyperactive *Bombyx* transposases include polypeptides comprising an amino acid substitution at a position selected from 92, 93, 96, 97, 165, 178, 189, 196, 200, 201, 211, 215, 235, 238, 246, 253, 258, 261, 263, 271, 303, 321, 324, 330, 373, 389, 399, 402, 403, 404, 448, 473, 484, 507, 523, 527, 528, 543, 549, 550, 557, 601, 605, 607, 609 or 610 (relative to SEQ ID NO: 407). Preferred hyperactive *Bombyx* transposases include polypeptides comprising an amino acid substitution, relative to SEQ ID NO: 407, selected from Q92A, V93L, V93M, P96G, F97H, F97C, H165E, H165W, E178S, E178H, C189P, A196G, L200I, A201Q, L211A, W215Y, G219S, Q235Y, Q235G, Q238L, K246I, K253V, M258V, F261L, S263K, C271S, N303R, F321W, F321D, V324K, V324H, A330V, L373C, L373V, V389L, S399N, R402K, T403L, D404Q, D404S, D404M, N441R, G448W, E449A, V469T, C473Q, R484K, T507C, G523A, I527M, Y528K, Y543I, E549A, K550M, P557S, E601V, E605H, E605W, D607H, S609H or L610I, and any combination thereof. Some combinations include at least 1, 2, 3, 4, 5, 6, 7, 8, 9, 10 or all of these mutations. Some preferred hyperactive transposases comprise an amino acid sequence, other than a naturally occurring protein, that is at least 85% identical or at least 90% identical or at least 95% identical, or at least 99% identical to the amino acid sequence of SEQ ID NO: 415 and that comprises at least one amino acid substitution (relative to SEQ ID NO: 407) shown in Table 4 column F, Table 4, G or Table 11 column H.

*Bombyx* transposase variants that are active for excision but deficient in integration in yeast and mammalian cells were prepared as described in Example 6.3.2.1. Preferred integration-deficient transposase sequences comprise one of SEQ ID NOS: 409-411; these integration deficient transposases may further comprise a heterologous nuclear localization sequence. Preferred integration-deficient transposases comprise an amino acid sequence, other than a naturally occurring protein, that is at least 90% identical to the amino acid sequence of SEQ ID NO: 411.

Methods of creating transgenic cells using hyperactive *Bombyx* transposases are an aspect of the invention. A method of creating a transgenic cell comprises (i) introducing into a eukaryotic cell a hyperactive *Bombyx* transposase (as a protein or as a polynucleotide encoding the transposase) and a corresponding *Bombyx* transposon; (ii) identifying a cell in which a *Bombyx* transposon is incorporated into the genome of the eukaryotic cell. Identifying the cell in which a *Bombyx* transposon is incorporated into the genome of the eukaryotic cell may comprise selecting the eukaryotic cell for a selectable marker encoded on the *Bombyx* transposon. The selectable marker may be any selectable polypeptide, including any described herein.

5.2.8 Gene Transfer Systems

Gene transfer systems comprise a polynucleotide to be transferred to a host cell. The gene transfer system may comprise any of the transposons or transposases described herein, or it may comprise one or more polynucleotides that have other features that facilitate efficient gene transfer without the need for a transposase or transposon.

When there are multiple components of a gene transfer system, for example the one or more polynucleotides comprising genes for expression in the target cell and optionally comprising transposon ends, and a transposase (which may be provided either as a protein or encoded by a nucleic acid), these components can be transfected into a cell at the same time, or sequentially. For example, a transposase protein or its encoding nucleic acid may be transfected into a cell prior to, simultaneously with or subsequent to transfection of a corresponding transposon. Additionally, administration of either component of the gene transfer system may occur repeatedly, for example, by administering at least two doses of this component.

*Bombyx* or *Xenopus* transposase proteins may be encoded by polynucleotides including RNA or DNA. Preferable RNA molecules include those with appropriate substitutions to reduce toxicity effects on the cell, for example substitution of uridine with pseudouridine, and substitution of cytosine with 5-methyl cytosine. Similarly, the nucleic acid encoding the transposase protein or the transposon of this invention can be transfected into the cell as a linear fragment or as a circularized fragment, either as a plasmid or as recombinant viral DNA.

The components of the gene transfer system may be transfected into one or more cells by techniques such as particle bombardment, electroporation, microinjection, combining the components with lipid-containing vesicles, such as cationic lipid vesicles, DNA condensing reagents (example, calcium phosphate, polylysine or polyethyleneimine), and inserting the components (that is the nucleic acids thereof into a viral vector and contacting the viral vector with the cell. Where a viral vector is used, the viral vector can include any of a variety of viral vectors known in the art including viral vectors selected from the group consisting of a retroviral vector, an adenovirus vector or an adeno-associated viral vector. The gene transfer system may be formulated in a suitable manner as known in the art, or as a pharmaceutical composition or kit.

5.2.9 Sequence Elements in Gene Transfer Systems

Expression of genes from a gene transfer polynucleotide integrated into a host cell genome is often strongly influenced by the chromatin environment into which it integrates. Polynucleotides that are integrated into euchromatin have higher levels of expression than those that are either integrated into heterochromatin, or which become silenced following their integration. Silencing of a heterologous polynucleotide may be reduced if it comprises a chromatin control element. It is thus advantageous for gene transfer systems to comprise chromatin control elements such as sequences that prevent the spread of heterochromatin (insulators). For example, it is advantageous for a gene transfer polynucleotide that will be integrated into a host genome to comprise a sequence that is at least 95% identical to a sequence selected from one of SEQ ID NOS: 869-876 and SEQ ID NO: 866. Advantageous gene transfer polynucleotides comprise an insulator sequence that is at least 95% identical to a sequence selected from one of SEQ ID NOS: 859-865, they may also comprise ubiquitously acting chromatin opening elements (UCOEs) or stabilizing and anti-repressor elements (STARs), to increase long-term stable expression from the integrated gene transfer polynucleotide.

In some cases, it is advantageous for a gene transfer polynucleotide to comprise two insulators, one on each side of the heterologous polynucleotide that contains the sequences to be expressed. The insulators may be the same, or they may be different. Particularly advantageous gene transfer polynucleotides comprise a sequence that is at least 95% identical to a sequence selected from one of SEQ ID NO: 864 or SEQ ID NO: 865 and a sequence that is at least 95% identical to a sequence selected from one of SEQ ID NOS: 859-865. Insulators also shield expression control elements from one another. For example, when a gene transfer polynucleotide comprises genes encoding two open reading frames, each operably linked to a different promoter, one promoter may reduce expression from the other in a phenomenon known as transcriptional interference. Interposing an insulator sequence that is at least 95% identical to a sequence selected from one of SEQ ID NOS: 859-865 between the two transcriptional units can reduce this interference, and increase expression from one or both promoters.

In preferred embodiments, a gene transfer vector comprises expression elements capable of driving high levels of gene expression. In eukaryotic cells, gene expression is regulated by several different classes of elements, including enhancers, promoters, introns, RNA export elements, polyadenylation sequences and transcriptional terminators.

Particularly advantageous gene transfer polynucleotides for the transfer of genes for expression into mammalian cells comprise an enhancer for immediate early genes 1, 2 and 3 of cytomegalovirus (CMV) from either human or murine cells (for example sequences at least 95% identical to any of SEQ ID NOS: 877-889), an enhancer from the adenoviral major late protein enhancer (for example sequences at least 95% identical to SEQ ID NO: 890), or an enhancer from SV40 (for example sequences at least 95% identical to SEQ ID NO: 891).

Particularly advantageous gene transfer polynucleotides for the transfer of genes for expression into mammalian cells comprise an EF1a promoter from any mammalian or avian species including human, rat, mice, chicken and Chinese hamster, (for example sequences at least 95% identical to any of SEQ ID NOS: 892-910); a promoter from the immediate early genes 1, 2 and 3 of cytomegalovirus (CMV) from either human or murine cells (for example sequences at least 95% identical to any of SEQ ID NOS: 911-920); a promoter for eukaryotic elongation factor 2 (EEF2) from any mammalian or avian species including human, rat, mice, chicken and Chinese hamster, (for example sequences at least 95% identical to any of SEQ ID NOS: 921-928); a GAPDH promoter from any mammalian or yeast species (for example sequences at least 95% identical to any of SEQ ID NOS: 936 and 949-951), an actin promoter from any mammalian or avian species including human, rat, mice, chicken and Chinese hamster (for example sequences at least 95% identical to any of SEQ ID NOS: 929-935); a PGK promoter from any mammalian or avian species including human, rat, mice, chicken and Chinese hamster (for example sequences at least 95% identical to any of SEQ ID NOS: 937-940), or a ubiquitin promoter (for example sequences at least 95% identical to SEQ ID NO: 941).

Particularly advantageous gene transfer polynucleotides for the transfer of genes for expression into mammalian cells comprise an intron from immediate early genes 1, 2 and 3 of cytomegalovirus (CMV) from either human or murine cells (for example sequences at least 95% identical to any of SEQ ID NOS: 958-965), an intron from EF1a from any mammalian or avian species including human, rat, mice, chicken and Chinese hamster, (for example sequences at least 95% identical to any of SEQ ID NOS: 970-976), an intron from EEF2 from any mammalian or avian species including human, rat, mice, chicken and Chinese hamster, (for example sequences at least 95% identical to any of SEQ ID NOS: 989-996); an intron from actin from any mammalian or avian species including human, rat, mice, chicken and Chinese hamster (for example sequences at least 95% identical to any of SEQ ID NOS: 977-985), a GAPDH intron from any mammalian or avian species including human, rat, mice, chicken and Chinese hamster (for example sequences at least 95% identical to any of SEQ ID NOS: 986 or 987); an intron comprising the adenoviral major late protein enhancer for example sequences at least 95% identical to SEQ ID NO: 988) or a hybrid/synthetic intron (for example sequences at least 95% identical to any of SEQ ID NOS: 966-969).

Particularly advantageous gene transfer polynucleotides comprise combinations of promoters and introns in which a promoter from one gene is combined with an intron for a different gene, that is the intron is heterologous to the promoter. For example, an immediate early CMV promoter from mouse (e.g. SEQ ID NOS: 916-920) or from human (for example, SEQ ID NOS: 912-915) is advantageously followed by an intron from EF1a (e.g. SEQ ID NOS: 970-976) or an intron from EEF2 (for example, SEQ ID NOS: 989-996).

Particularly advantageous gene transfer polynucleotides for the transfer of genes for expression into mammalian cells comprise one or more of an expression enhancer that enhances RNA export from the nucleus such as woodchuck hepatitis post-transcriptional regulatory element (WPRE) or hepatitis B virus post-transcriptional regulatory element (HPRE) (for example sequences at least 95% identical to any of SEQ ID NOS: 867 or 868) and elements such as scaffold attachment region (SAR) sequences (for example sequences at least 95% identical to any of SEQ ID NOS: 869-876). These expression enhancing elements are particularly advantageous when placed 3' of a sequence to be expressed. We have determined that SAR sequences SEQ ID NOs: 869-871 enhance expression of an open reading frame more when they are within the transcript than when they are after the polyadenylation signal. This is unexpected, since the proposed role of SARs is in attaching the genomic DNA sequences to the nuclear scaffold. SAR SEQ ID NOs: 869-871 are particularly beneficial to expression of a polypeptide when combined with naturally occurring HPRE post-transcriptional regulatory element SEQ ID NO: 868, for example as in SEQ ID NO: 866. They are equally beneficial when combined with a modified variant of HPRE post-transcriptional regulatory element SEQ ID NO: 867, which we made by introducing a matched pair of mutations to remove a BfuAI restriction site without altering the RNA stem-loop structure of the element, for example as in SEQ ID NO: 1100. We tested the expression-enhancing effects of SEQ ID NO: 1100, by comparing expression of a gene encoding DasherGFP from polynucleotides that comprised either SEQ ID NO: 866 or SEQ ID NO: 1100 or no additional expression enhancing elements between the DasherGFP gene and the rabbit globin polyA sequence. The polynucleotides were integrated into the genome of CHO cells, and expression of DasherGFP measured. SEQ ID NO: 866 and SEQ ID NO: 1100 both produced expression levels of Dasher GFP that were at least 110% or at least 120% or at least 200% or at least 500% of the expression achieved without either element. Advantageous gene transfer polynucleotides comprise a sequence that is at least 95% identical or at least 98% identical or at least 99% identical or at least 99.5% identical to SEQ ID NO: 866, or a sequence that is either SEQ ID NO: 866 or SEQ ID NO: 1100. These are particularly beneficial when further combined with a strong polyadenylation signal sequence, for example the signal from the rabbit beta globin gene, for example as in SEQ ID NO: 1101-2. The effects of these elements may be further enhanced when combined with an insulator sequence. Particularly advantageous combinations are given as SEQ ID NO: 820-858. An advantageous gene transfer polynucleotide comprises a sequence that is at least 90% identical or at least 95% identical or at least 99% identical with any of SEQ ID NO: 820-858. Particularly advantageous gene transfer polynucleotides comprise a *Xenopus* or *Bombyx* transposon comprising a sequence that is at least 90% identical or at least 95% identical or at least 99% identical to a sequence selected from SEQ ID NO: 820-858.

Particularly advantageous gene transfer polynucleotides for the transfer of a first and a second gene for co-expression into mammalian cells comprise a promoter and optionally enhancer and introns operably linked to the first gene, and a translational coupling element such as an IRES operably linking expression of a second gene to the first. Particularly advantageous gene transfer polynucleotides comprise an IRES sequence selected from SEQ ID NOS: 1050-1094.

Expression of two genes from a single polynucleotide can also be accomplished by operably linking the expression of each gene to a separate promoter, each of which may optionally be operably linked to enhancers and introns as described above. It is often advantageous to place a genetic insulator such as the HS4core or D4Z4 core, between the two promoters, for example after the polyadenylation sequence operably linked to the gene encoding the first polypeptide and before the promoter operably linked to the gene encoding the second polypeptide. See Example 6.2.1 and Table 7, and compare row 12 with row 13, row 14 with row 15, row 16 with row 17, row 18 with row 19, row 20 with row 21 and row 22 with row 23. In each case the expression of the first polypeptide, the second polypeptide or both polypeptides was increased by the presence of an insulator sequence interposed between the two promoters.

Particularly advantageous combinations of promoters for expression of two polypeptides include configurations in which one polypeptide is expressed operably linked to the EF1a promoter or the CMV promoter and the second polypeptide is expressed operably linked to the CMV promoter, the GAPDH promoter, the EF1a promoter or the actin promoter. Specific combinations of polyadenylation signals, terminators, enhancers, promoters, introns, 5'UTRs and insulators sequences that work well when placed following a gene that encodes a first polypeptide and preceding a gene that encodes a second polypeptide (i.e. in a spacer polynucleotide) include SEQ ID NOS: 998-1049. Particularly advantageous gene transfer polynucleotides for the transfer of a first and a second gene for co-expression into mammalian cells comprise a sequence at least 90% identical or at least 95% identical or at least 99% identical to a sequence selected from SEQ ID NOS: 998-1049.

5.2.10 Increasing Expression by Selection

High levels of expression may be obtained from genes encoded on gene transfer polynucleotides that are integrated at regions of the genome that are highly transcriptionally active, or that are integrated into the genome in multiple copies, or that are present extrachromosomally in multiple copies.

The expression of a first expression polypeptide encoded on a gene transfer polynucleotide (the "expression polypeptide") can be increased if the gene transfer polynucleotide also comprises a sequence encoding a selectable polypeptide. It is often advantageous to operably link the gene encoding the selectable polypeptide to expression control elements that result in low levels of expression of the selectable polypeptide from the gene transfer polynucleotide and/or to use conditions that provide more stringent selection. Under these conditions, for the expression cell to produce sufficient levels of the selectable polypeptide encoded on the gene transfer polynucleotide to survive the selection conditions, the gene transfer polynucleotide must either be present in a favorable location in the cell's genome for high levels of expression, or a sufficiently high number of copies of the gene transfer polynucleotide must be present, such that these factors compensate for the low levels of expression achievable because of the expression control elements.

The expression polypeptide and the selectable polypeptide may be included on the same gene transfer polynucleotide, but operably linked to different promoters. In this case low expression levels of the selectable marker may be achieved by using a weakly active constitutive promoter such as the phosphoglycerokinase (PGK) promoter (e.g. SEQ ID NOS: 937-940), the Herpes Simplex Virus thymidine kinase (HSV-TK) promoter (e.g. SEQ ID NO: 943), the MC1 promoter (for example SEQ ID NO: 944), the ubiquitin promoter (for example SEQ ID NO: 941). Other weakly active promoters maybe deliberately constructed, for example a promoter attenuated by truncation, such as a truncated SV40 promoter (for example SEQ ID NO: 945 or 946), a truncated HSV-TK promoter (for example SEQ ID NO: 942), or a promoter attenuated by insertion of a 5'UTR unfavorable for expression between a promoter and the gene encoding the selectable polypeptide, for example SEQ ID NOS: 956 or 957. Examples of attenuated promoters include an attenuated PGK promoter (SEQ ID NO: 947) and an attenuated HSV-TK promoter (SEQ ID NO: 948). Particularly advantageous gene transfer polynucleotides comprise a sequence that is at least 90% identical or at least 95% identical or at least 99% identical to any of SEQ ID NOS: 937-948, operably linked to a gene encoding a selectable marker.

Expression levels of a selectable marker may also be advantageously reduced by other mechanisms such as the insertion of the SV40 small t antigen intron after the gene for the selectable marker. The SV40 small t intron accepts aberrant 5' splice sites, and can lead to deletions within the preceding gene in a fraction of the spliced mRNAs, thereby reducing expression of the selectable marker. Particularly advantageous gene transfer polynucleotides comprise intron SEQ ID NO:997, operably linked to a gene encoding a selectable marker. For this mechanism of attenuation to be effective, it is preferable for the gene encoding the selectable marker to comprise a strong intron donor within its coding region. Glutamine synthase SEQ ID NO: 703 may be encoded by the sequence SEQ ID NO: 704 which comprises a strong intron donor. Puromycin acetyl transferase SEQ ID NO: 715 may be encoded by the sequence SEQ ID NO: 716 which comprises a strong intron donor. Particularly advantageous gene transfer polynucleotides comprise a sequence at least 90% identical or at least 95% identical or at least 99% identical to either of SEQ ID NO: 704 or SEQ ID NO: 716, and SEQ ID NO:997.

Expression levels of a selectable marker may also be advantageously reduced by other mechanisms such as insertion of an inhibitory 5'-UTR within the transcript, for example SEQ ID NO: 956 or 957. Particularly advantageous gene transfer polynucleotides comprise a promoter operably linked to a gene encoding a selectable marker, wherein a sequence that is at least 90% identical or at least 95% identical or at least 99% identical to SEQ ID NO: 956 or 957 is interposed between the promoter and the selectable marker.

Table 13 shows the transposition of transposons comprising a puromycin selectable marker operably linked to a relatively strong PGK promoter (SEQ ID NO: 937; Table 13 rows 2-4), or to a weaker HSV-TK promoter (SEQ ID NO: 942; Table 13 rows 5-9). Expression from transposons in which puromycin acetyl transferase was operably linked to the weaker promoter was substantially higher than from transposons in which puromycin acetyl transferase was operably linked to the stronger promoter. However, this high expression required co-transfection of the transposon with a transposase. By operably linking the selectable marker to elements that result in weak expression, cells are selected which either incorporate multiple copies of the transposon, or in which the transposon is integrated at a favorable genomic location for high expression. Using a gene transfer system that comprises a transposon and a corresponding transposase, particularly a *Xenopus* transposon and a hyperactive *Xenopus* transposase or a *Bombyx* transposon and a hyperactive *Bombyx* transposase increases the likelihood that cells will be produced with multiple copies of the transposon, or in which the transposon is integrated at a favorable genomic location for high expression, as shown in Examples 6.3.1.2 and 6.3.2.2. Gene transfer systems comprising a transposon and a corresponding transposase are thus particularly advantageous when the transposon comprises a selectable marker operably linked to weak promoters, and when the transposase is a hyperactive transposase. Particularly advantageous transposons comprise selectable markers operably linked to a promoter with at least 90% identity or at least 95% identity or at least 99% identity to a sequence selected from SEQ ID NOS: 942-948. Particularly advantageous gene transfer polynucleotides comprise sequences with at least 90% identity or at least 95% identity or at least 99% identity to a sequence selected from SEQ ID NOS: 719-749.

Another way to select for high levels of expression of a first expression polypeptide, is to translationally couple the gene encoding a selectable marker and the first expression polypeptide using an IRES. Preferably the IRES results in a much higher expression of the first expression polypeptide than the selectable marker. Many new IRES activities are shown in Table 9 and described in Example 6.4.1. In these examples, the first expression polypeptide is a green fluorescent protein and the selectable polypeptide is a red fluorescent protein. Each table also shows the expression level of the first expression polypeptide in a construct lacking the IRES and gene for the selectable polypeptide. Particularly desirable IRES elements are those that have a high ratio of expression between the first expression polypeptide and the selectable polypeptide, and that also have levels of expression of the first expression polypeptide that are close to the levels of expression obtained in the absence of the IRES and gene for the selectable polypeptide. From Table 9, it can be seen that IRES SEQ ID NOs: 1089, 1078, 1080, 1086, 1076, 1075, 1081, 1077, 1088, 1079, 1091, 1066, 1094, 1093, 1072, 1068, 1071 have levels of expression of the first expression polypeptide that are at least 50% of the levels of expression obtained in the absence of the IRES and a second open reading frame in CHO cells, and IRES SEQ ID NOs: 1084, 1079, 1073, 1085, 1082, 1074, 1080, 1066 have levels of expression of the first expression polypeptide that are at least 50% of the levels of expression obtained in the absence of the IRES and a second open reading frame in HEK cells. IRES SEQ ID NOs: 1091, 1070, 1069, 1090, 1094, 1077, 1067, 1089, 1068, 1078, 1066, 1072, 1093, 1092, 1079, 1080, 1081, 1052, 1074, 1085, 1076, 1088, 1075 and 1086 all express the second ORF at 15% or less than the level of the first ORF in CHO cells. IRES SEQ ID NOs: 1091, 1067, 1094, 1070, 1089, 1092, 1090, 1069, 1078, 1074, 1077, 1085, 1084, 1053, 1096 and 1073 all express the second ORF at 20% or less than the level of the first ORF in HEK cells.

These IRES elements are therefore particularly advantageous, when used to link the expression of a first expression polypeptide to the expression of a gene encoding a selectable marker in a gene transfer polynucleotide, wherein the gene transfer polynucleotide comprises a gene encoding a first expression polypeptide on the 5' side of the IRES and a gene encoding a selectable marker on the 3' side of the IRES. Particularly advantageous gene transfer polynucleotides comprise selectable markers operably linked to an IRES selected from SEQ ID NOS: 1052, 1053, 1066, 1068, 1072, 1073, 1074, 1075, 1076, 1077, 1078, 1079, 1080, 1081, 1084, 1085, 1086, 1088, 1089, 1090, 1091, 1093 or 1094.

Common selectable polypeptides confer resistance of eukaryotic cells to antibiotics such as neomycin (resistance conferred by an aminoglycoside 3'-phosphotransferase e.g. SEQ ID NO: 709-712), puromycin (resistance conferred by puromycin acetyltransferase e.g. SEQ ID NOS: 713-716), blasticidin (resistance conferred by a blasticidin acetyltransferase and a blasticidin deaminase), hygromycin B (resistance conferred by hygromycin B phosphotransferase e.g. SEQ ID NO: 717-718 and zeocin (resistance conferred by binding protein, for example SEQ ID NO: 702). Other selectable polypeptides include those that are fluorescent (such as GFP, RFP etc.) and can therefore be selected for example using flow cytometry. Other selectable polypeptides include transmembrane proteins that are able to bind to a second molecule (protein or small molecule) that can be fluorescently labelled so that the presence of the transmembrane protein can be selected for example using flow cytometry.

Glutamine synthase (GS, for example SEQ ID NOS: 703 and 705) is used as a selectable marker that allows selection via glutamine metabolism. Glutamine synthase is the enzyme responsible for the biosynthesis of glutamine from glutamate and ammonia, and is a crucial component of the only pathway for glutamine formation in a mammalian cell. In the absence of glutamine in the growth medium, the GS enzyme is essential for the survival of mammalian cells in culture. Some cell lines, for example mouse myeloma cells do not express sufficient GS enzyme to survive without added glutamine. In these cells a transfected GS gene can function as a selectable marker by permitting growth in a glutamine-free medium. In other cell lines, for example Chinese hamster ovary (CHO) cells express sufficient GS enzyme to survive without exogenously added glutamine. These cell lines can be manipulated by genome editing techniques including CRISPR/Cas9 to reduce or eliminate the activity of the GS enzyme. In all of these cases, GS inhibitors such as methionine sulphoximine (MSX) can be used to inhibit a cell's endogenous GS activity. Selection protocols include introducing a construct comprising sequences encoding a first polypeptide and a glutamine synthase selectable marker, and then treating the cell with inhibitors of glutamine synthase such as methionine sulphoximine. The higher the levels of methionine sulphoximine that are used, the higher the level of glutamine synthase expression is required to allow the cell to synthesize sufficient glutamine to survive. Some of these cells will also show an increased expression of the first polypeptide.

Preferably the GS gene is operably linked to a weak promoter or other sequence elements that attenuate expression as described herein, such that high levels of expression can only occur if many copies of the gene transfer polynucleotide are present, or if they are integrated in a position in the genome where high levels of expression occur.

A second system for increasing expression by selection uses the enzyme dihydrofolate reductase (DHFR, for example SEQ ID NO: 707 or 708) which is required for catalyzing the reduction of 5,6-dihydrofolate (DHF) to 5,6,7,8-tetrahydrofolate (THF) and is used as a selectable marker. Some cell lines do not express sufficient DHFR to survive without added THF. In these cells a transfected DHFR gene can function as a selectable marker by permitting growth in a THF-free medium. DHFR-deficient cell lines, for example Chinese hamster ovary (CHO) cells can be produced by genome editing techniques including CRISPR/Cas9 to reduce or eliminate the activity of the endogenous DHRF enzyme. DHFR confers resistance to methotrexate (MTX). DHFR can be inhibited by higher levels of methotrexate. Selection protocols include introducing a construct comprising sequences encoding a first polypeptide and a DHFR selectable marker into a cell with or without an endogenous DHFR gene, and then treating the cell with inhibitors of DHFR such as methotrexate. The higher the levels of methotrexate that are used, the higher the level of DHFR expression is required to allow the cell to synthesize sufficient DHFR to survive. Some of these cells will also show an increased expression of the first polypeptide. Preferably the DHFR gene is operably linked to a weak promoter or other sequence elements that attenuate expression as described above, such that high levels of expression can only occur if many copies of the gene transfer polynucleotide are present, or if they are integrated in a position in the genome where high levels of expression occur.

The combination of selectable marker and its operably linked control elements profoundly affect the expression that can be obtained from a gene transfer polynucleotide. Particularly advantageous gene transfer polynucleotides comprise a sequence that is at least 90% identical or at least 95% identical or at least 99% identical to a sequence selected from SEQ ID NOS: 719-749. Preferably these sequences are flanked by a pair of transposon ends.

As shown in Table 15 and described in Example 6.3.2.2, the combination of selectable marker and its operably linked control elements profoundly affect the expression that can be obtained from a second promoter on a gene transfer polynucleotide. These effects are also influenced by the presence of insulator sequences on the gene transfer polynucleotide. Particularly advantageous gene transfer polynucleotides comprise a sequence that is at least 90% identical or at least 95% identical or at least 99% identical to a sequence selected from SEQ ID NOS: 751-819. Particularly advantageous gene transfer polynucleotides comprise a *Xenopus* or *Bombyx* transposon comprising a sequence that is at least 90% identical or at least 95% identical or at least 99% identical to a sequence selected from SEQ ID NOS: 751-819.

The use of transposons and transposases in conjunction with such selectable markers that are required for normal cell metabolism has several advantages over non-transposon constructs. One is that linkage between expression of the first polypeptide and the selectable marker is better for transposons, because a transposase will integrate the entire sequence that lies between the two transposon ends into the genome. In contrast when heterologous DNA is introduced into the nucleus of a eukaryotic cell, for example a mammalian cell, it is gradually broken into random fragments which may either be integrated into the cell's genome, or degraded. Thus if a construct comprising sequences that encode a first polypeptide and a selectable marker required for normal cell metabolism is introduced into a population of cells, some cells will integrate the sequences encoding the selectable marker but not those encoding the first polypeptide, and vice versa. Selection of cells expressing high levels of selectable marker is thus only somewhat correlated with cells that also express high levels of the first polypeptide. In contrast, because the transposase integrates all of the sequences between the transposon ends, cells expressing high levels of selectable marker are highly likely to also express high levels of the first polypeptide.

A second advantage of transposons and transposases is that they are much more efficient at integrating DNA sequences into the genome. Thus a much higher fraction of the cell population is likely to receive one or more copies of the construct in their genomes, so there will be a correspondingly higher likelihood of good stable expression of both the selectable marker and the first polypeptide.

A transposon that comprises a sequence encoding a first polypeptide and a selectable marker that can be inhibited by a small molecule inhibitor may thus be used to obtain cells expressing high levels of the first polypeptide. The first polypeptide may be part of an antibody. Preferred selectable markers are glutamine synthase and DHFR.

Higher numbers of integrated transposons may be selected using selectable markers required for normal cell metabolism such as DHFR or glutamine synthase.

5.3 Kits

The present invention also features kits comprising a *Bombyx* transposase as a protein or encoded by a nucleic acid, and/or a *Bombyx* transposon; or a gene transfer system as described herein comprising a *Bombyx* transposase as a protein or encoded by a nucleic acid as described herein, in combination with a *Bombyx* transposon; optionally together with a pharmaceutically acceptable carrier, adjuvant or vehicle, and optionally with instructions for use. Any of the components of the inventive kit may be administered and/or transfected into cells in a subsequent order or in parallel, e.g. a *Bombyx* transposase protein or its encoding nucleic acid may be administered and/or transfected into a cell as defined above prior to, simultaneously with or subsequent to administration and/or transfection of a *Bombyx* transposon. Alternatively, a *Bombyx* transposon may be transfected into a cell as defined above prior to, simultaneously with or subsequent to transfection of a *Bombyx* transposase protein or its encoding nucleic acid. If transfected in parallel, preferably both components are provided in a separated formulation and/or mixed with each other directly prior to administration to avoid transposition prior to transfection. Additionally, administration and/or transfection of at least one component of the kit may occur in a time staggered mode, e.g. by administering multiple doses of this component.

In addition, the present invention also features kits comprising a *Xenopus* transposase as a protein or encoded by a nucleic acid, and/or a *Xenopus* transposon; or a gene transfer system as described herein comprising a *Xenopus* transposase as a protein or encoded by a nucleic acid as described herein, in combination with a *Xenopus* transposon; optionally together with a pharmaceutically acceptable carrier, adjuvant or vehicle, and optionally with instructions for use. Any of the components of the inventive kit may be administered and/or transfected into cells in a subsequent order or in parallel, e.g. a *Xenopus* transposase protein or its encoding nucleic acid may be administered and/or transfected into a cell as defined above prior to, simultaneously with or subsequent to administration and/or transfection of a *Xenopus* transposon. Alternatively, a *Xenopus* transposon may be transfected into a cell as defined above prior to, simultaneously with or subsequent to transfection of a *Xenopus* transposase protein or its encoding nucleic acid. If transfected in parallel, preferably both components are provided in a separated formulation and/or mixed with each other directly prior to administration the to avoid transposition prior to transfection. Additionally, administration and/or transfection of at least one component of the kit may occur in a time staggered mode, e.g. by administering multiple doses of this component.

6. EXAMPLES

The following examples illustrate the methods, compositions and kits disclosed herein and should not be construed as limiting in any way. Various equivalents will be apparent from the following examples; such equivalents are also contemplated to be part of the invention disclosed herein.

6.1 Transposases 6.1.1 *Xenopus*- and *Bombyx*-Derived Transposases

Joining a pair of transposon ends onto the ends of a heterologous polynucleotide can create a synthetic transposon that can be integrated into a target genome by a transposase. Table 1 shows the configurations of 4 different synthetic transposons created by joining the transposon end whose SEQ ID NO is given in column A to one side of the reporter construct SEQ ID NO: 39, joining the transposon end whose SEQ ID NO is given in column B to the other side of the reporter construct and flanking both by the target sequence given in column C. These transposons were then transfected into CHO-K1 cells together with genes encoding transposases whose SEQ ID NO is shown in column F, operably linked to the CMV promoter. The amount of each DNA in each transfection is shown in columns E (transposon) and H (transposase) of Table 1.

CHO-K1 cells were transfected and puromycin-selected as described in Section 4.2.1. Fluorescence was measured at Ex/Em of 488/518 nm, and is a measure of expression of the ORF encoding fluorescent reporter DasherGFP from stably integrated transposons, fluorescence from 3 independent transfections is shown in Table 1 columns J-L.

Table 1 rows 3, 5, 10 and 15 show the results from three different transposons transfected into CHO cells without any co-transfected transposase. In each case there were few to no live cells that survived the puromycin selection (column I), and no fluorescence from the Dasher GFP (columns J, K and L), indicating that the transposons had either not integrated, or not integrated in a way that allowed subsequent expression of the genes encoded on the transposons.

Table 1 rows 3 and 4 compares fluorescence obtained from a transposon with ends taken from the looper moth *Trichoplusia ni* piggyBac transposon (SEQ ID NO: 35 and 36), either transfected alone (row 3) or co-transfected with a plasmid carrying a gene encoding the hyperactive piggyBac transposase (SEQ ID NO 698) operably linked to the CMV promoter (row 4). Co-transfection with the transposase gene increased cell viability to give 100% confluence, and the fluorescent signal increased from background to ~660 units.

Table 1 rows 5-14 compares fluorescence obtained from a transposon with ends with SEQ ID NO: 1 and 11, either transfected alone (row 5) or co-transfected with a gene encoding *Xenopus* transposase SEQ ID NO: 49 alone (row 7) or fused to a heterologous nuclear localization signal (row 6), or co-transfected with a gene encoding *Xenopus* transposase SEQ ID NO: 48 alone (row 9) or fused to a heterologous nuclear localization signal (row 8); or a transposon with ends with SEQ ID NO: 3 and 12, either transfected alone (row 10) or co-transfected with a gene encoding *Xenopus* transposase SEQ ID NO: 49 alone (row 12) or fused to a heterologous nuclear localization signal (row 11), or co-transfected with a gene encoding *Xenopus* transposase SEQ ID NO: 48 alone (row 14) or fused to a heterologous nuclear localization signal (row 13). Co-transfection with either transposase fused to a nuclear localization signal increased cell viability to give 100% confluence, and the fluorescent signal increased from background to ~1,000 units. In the absence of the nuclear localization signal viable cells and expression levels were less than 10% of the values obtained with the transposases fused to heterologous nuclear localization signals. Heterologous nuclear localization signals are thus required for naturally occurring *Xenopus* transposases (for example SEQ ID NOS: 48 and 49) to efficiently integrate transposons into the nucleus of mammalian cells in a way that allows subsequent expression of the genes encoded on the transposons.

The data in Table 1 shows that, when fused to a heterologous nuclear localization signal, *Xenopus* transposases SEQ ID NO: 48 and 49 are active at transposing synthetic *Xenopus* transposons into the genome of a mammalian cell. These transposon ends each contain an ITR with the sequence 5'-CCYTTTBMCTGCCA-3' (SEQ ID NO: 19), where the ITRs are found in the two ends in an inverted orientation relative to each other. It also shows that the fusion of these transposases to a heterologous nuclear localization signal are more active in this assay than the hyperactive piggyBac transposase derived from the looper moth *Trichoplusia ni*.

Table 1 rows 15-19 compares fluorescence obtained from a transposon with ends with SEQ ID NO: 23 and 29, either transfected alone (row 15) or co-transfected with a gene encoding *Bombyx* transposase SEQ ID NO: 750 alone (row 17) or fused to a heterologous nuclear localization signal (row 16), or co-transfected with a gene encoding *Bombyx* transposase SEQ ID NO: 407 alone (row 19) or fused to a heterologous nuclear localization signal (row 18). Co-transfection with transposase SEQ ID NO: 407, whether or not it was fused to a nuclear localization signal increased cell viability to give 100% confluence, and the fluorescent signal increased from background to ~1,000 units. Co-transfection with transposase SEQ ID NO: 750, whether or not it was fused to a nuclear localization signal resulted in viable cells and expression levels were less than 1% of the values obtained with the transposase SEQ ID NO: 407. Thus transposase SEQ ID NO: 407 is active at transposing synthetic *Bombyx* transposons into the genome of a mammalian cell.

6.1.2 *Xenopus*- and *Bombyx*-Derived Transposons

6.1.2.1 *Bombyx* Transposon Ends

Transposon ends of naturally occurring transposons were modified by truncation or by changing the target sequences. These transposon ends were then joined to the ends of a heterologous polynucleotide to create synthetic transposons that can be integrated into a target genome by a transposase. Table 2 shows the configurations of 12 different synthetic transposons created by joining the transposon end whose SEQ ID NO is given in column A to one side of the reporter construct SEQ ID NO: 39, joining the transposon end whose SEQ ID NO is given in column B to the other side of the reporter construct and flanking both by the target sequence given in column C. These transposons were then transfected into CHO-K1 cells together with genes encoding transposases whose SEQ ID NO is shown in column G, optionally fused to a heterologous nuclear localization signal (as shown in column H) and operably linked to the CMV promoter. The amount of each DNA in each transfection is shown in columns F (transposon) and I (transposase) of Table 2. Transfection and selection were as described in Section 4.2.1.

Cells were harvested by scraping and measured in a fluorimetric plate reader, fluorescence from 3 independent transfections is shown in Table 2 columns J-L. Fluorescence was measured at Ex/Em of 488/518 nm, and is a measure of expression of the ORF encoding fluorescent reporter DasherGFP from stably integrated transposons.

*Bombyx* left and right transposon ends could both be truncated from the proximal end (that is the end furthest from the ITR) while retaining transposon function. Table 2 rows 2-9 show that expression from heterologous polynucleotides inserted into the CHO genome was enhanced by co-transfection with a construct encoding *Bombyx* transposase SEQ ID NO: 407 wherein the heterologous polynucleotides comprised a left transposon end of a target sequence followed by SEQ ID NO: 23, 24 or 25, and a right transposon end of SEQ ID NO: 29 or 31 followed by a target sequence.

The test performed here shows that these ends comprise all of the sequences necessary to create a *Bombyx* transposon that can be integrated into the genome of a target cell. However, it has previously been shown for the looper moth piggyBac transposon that longer sequences are required for transformation of target genomes than for excision of the transposon by the transposase, or for inter-plasmid transposition, as described in Li et. al (2005) Insect Mol. Biol. 14: 17-30. "piggyBac internal sequences are necessary for efficient transformation of target genomes." and Li et. al (2001) Mol Genet Genomics 266:190-8. "The minimum internal and external sequence requirements for transposition of the eukaryotic transformation vector piggyBac.". We infer that shorter sequences of the *Bombyx* transposon will also be competent for excision or for inter-plasmid transposition. Important sequences for looper moth piggyBac transposon excision are the terminal repeats and internal repeats in each end. The *Bombyx* transposon comprises several internal repeats which probably perform analogous functions. *Bombyx* left end SEQ ID NO: 25 comprises SEQ ID NO: 1103, and an inverted copy of this SEQ ID NO: 1104; it also comprises SEQ ID NO: 1105, and an inverted copy of this SEQ ID NO: 1106; it also comprises two AT rich palindromes SEQ ID NO: 1107 and SEQ ID NO: 1108. *Bombyx* right end SEQ ID NO: 31 comprises two copies of the AT richsequence SEQ ID NO: 1110. *Bombyx* right end SEQ ID NO: 31 also comprises a copy of SEQ ID NO: 1106, which is found repeated in both orientations in left end SEQ ID NO: 25. *Bombyx* left end SEQ ID NO: 25 and right end SEQ ID NO: 31 also each comprise a copy of SEQ ID NO: 1109. A *Bombyx* transposon can comprise a left end comprising 1 or 2 or 3 or 4 or 5 or 6 or 7 sequences selected from SEQ ID NO: 1103-1110. A *Bombyx* transposon can comprise a right end comprising 1 or 2 or 3 sequences selected from SEQ ID NO: 1106 and 1109-1110.

We also found that we could change the 5'-TTAT-3' target sequence flanking the *Bombyx*-based transposon to 5'-TTAA-3' and still obtain a high transposase-dependent DasherGFP signal (compare rows 3 and 11 in Table 2). Thus a *Bombyx* transposase is effective at transposing transposons with different target sequences including 5'-TTAT-3' and 5'-TTAA-3' target sequences.

6.1.2.2 *Xenopus* Transposon Ends

Tables 2 and 3 also show expression from *Xenopus* transposons with truncated ends or modified target sequences. Both tables show the configurations of synthetic transposons created by joining the transposon end whose SEQ ID NO is given in column A to one side of the reporter construct SEQ ID NO: 39, joining the transposon end whose SEQ ID NO is given in column B to the other side of the reporter construct and flanking both by the target sequence given in column C. These transposons were then transfected into CHO-K1 cells together with genes encoding transposases whose SEQ ID NO is shown in column G, optionally fused to a heterologous nuclear localization signal (as shown in column H) and operably linked to the CMV promoter. The amount of each DNA in each transfection is shown in columns F (transposon) and I (transposase) of Tables 2 and 3. Transfection and selection were as described in Section 4.2.1.

Cells were harvested by scraping and measured in a fluorimetric plate reader, fluorescence from 3 independent transfections is shown in Tables 2 and 3 columns J-L. Fluorescence was measured at Ex/Em of 488/518 nm, and is a measure of expression of the ORF encoding fluorescent reporter DasherGFP from stably integrated transposons.

Table 2 rows 13-20 and Table 3 rows 2-11 show that expression from heterologous polynucleotides inserted into the CHO genome was enhanced by co-transfection with a construct encoding *Xenopus* transposase SEQ ID NO: 48 fused to a nuclear localization sequence, wherein the heterologous polynucleotides comprised a left transposon ends of a target sequence followed by SEQ ID NO: 1 or 3-7 and a right transposon end of SEQ ID NO: 11-13 or 15-16 followed by a target sequence.

The test performed here shows that these ends comprise all of the sequences necessary to create a *Xenopus* transposon that can be integrated into the genome of a target cell. However, it has previously been shown for the looper moth piggyBac transposon that longer sequences are required for transformation of target genomes than for excision of the transposon by the transposase, or for inter-plasmid transposition, as described in Li et. al (2005) Insect Mol. Biol. 14: 17-30. "piggyBac internal sequences are necessary for efficient transformation of target genomes." and Li et. al (2001) Mol Genet Genomics 266:190-8. "The minimum internal and external sequence requirements for transposition of the eukaryotic transformation vector piggyBac.". We infer that shorter sequences of the *Xenopus* transposon will also be competent for excision or for inter-plasmid transposition.

We also found that we could change a 5'-TTAA-3' target sequence flanking the *Xenopus*-based transposon to a 5'-TTAT-3' target sequence and still obtain a high transposase-dependent DasherGFP signal (compare rows 14 and 22 in Table 2). The ITRs for these transposons were adjacent to the left target sequence, sequence SEQ ID NO: 20 (5'-CCCTTTGCCTGCCA-3'), and adjacent to the right target sequence, sequence SEQ ID NO: 21 (5'-TGGCAGTGAAAGGG-3').

Thus a *Xenopus* transposase is effective at transposing transposons with different target sequences including 5'-TTAT-3' and 5'-TTAA-3' target sequences.

We also found that we could change the 5'-TTAA-3' target sequence flanking the *Trichoplusia ni*-based transposon to 5'-TTAT-3' and still obtain a high transposase-dependent DasherGFP signal (compare rows 24 and 26 in Table 2). Thus the *Trichoplusia ni* piggyBac transposase is effective at transposing transposons with different target sequences including 5'-TTAT-3' and 5'-TTAA-3' target sequences.

6.1.3 Transposon Integration by Transposase Provided as mRNA 6.1.3.1 *Xenopus* Transposase mRNA A transposase may be provided as a protein, or as a polynucleotide encoding the transposase; the encoding polynucleotide may be expressible DNA or RNA. mRNA encoding *Xenopus* transposase SEQ ID NO: 48 fused to a heterologous NLS was prepared as described in Section 4.2.3.

Transposon ends were joined to the ends of a heterologous polynucleotide to create synthetic transposons: the transposon ends whose SEQ ID NOs are given in columns A and B of Table 5 were joined to either side of reporter construct SEQ ID NO: 39, and flanked by 5'-TTAA-3' target sequences. These transposons were transfected into CHO-K1 cells together with polynucleotides encoding transposases whose SEQ ID NO is shown in column E of Table 5. If the polynucleotide was DNA, the gene encoding the transposase was operably linked to the promoter indicated in column G, and the amount of transposase gene DNA per transfection is indicated in column H. If the polynucleotide was provided as mRNA, the amount of RNA per transfection is indicated in column I. The amount of each transposon DNA in each transfection is shown in column D of Table 5. Transfection and selection was as described in Section 4.2.1.

Cells were harvested by scraping and measured in a fluorimetric plate reader. Fluorescence, shown in columns J-L, was measured at Ex/Em of 488/518 nm, and is a measure of expression of the ORF encoding fluorescent reporter DasherGFP from stably integrated transposons.

Table 5 shows that co-transfection of a transposon with *Xenopus* transposon ends (each comprising SEQ ID NO: 19)

together with mRNA encoding a *Xenopus* transposase fused to a heterologous NLS, resulted in up to 50× increases in expression relative to the cells transfected with transposon alone, and comparable to the expression enhancement obtained when the transposase was provided encoded in DNA (compare rows 9-12 with rows 5-8 and row 4. Also compare rows 18-21 with rows 14-17 and row 13). Thus a *Xenopus* transposase may be provided as mRNA that can be translated in the target cell.

6.1.3.2 *Bombyx* Transposase mRNA

A similar experiment to the one described in 6.1.3.1 was performed with mRNA encoding *Bombyx* transposase 407 fused to a heterologous NLS, also prepared by in vitro transcription as described in Section 4.2.3.

Transposon ends were joined to the ends of a heterologous polynucleotide to create synthetic transposons that can be integrated into a target genome by a transposase. Table 6 shows the configurations of 3 different synthetic transposons. Transposons had a 5'-TTAA-3' target sequence followed by a transposon end whose SEQ ID NO is given in column A, followed by the reporter construct whose SEQ ID NO is given in column B, followed by the transposon end whose SEQ ID NO is given in column C, followed by a 5'-TTAA-3' target sequence.

These transposons were transfected into CHO-K1 cells together with polynucleotides encoding transposases whose SEQ ID NO is shown in column F of Table 6. If the polynucleotide was DNA, the gene encoding the transposase was operably linked to the CMV promoter, and the amount of transposase gene DNA per transfection is indicated in column H. If the polynucleotide was provided as mRNA, the amount of RNA per transfection is indicated in column I. The amount of each transposon DNA in each transfection is shown in column E of Table 6. Transfection and selection were as described in Section 4.2.1. Cells were harvested by scraping and measured in a fluorimetric plate reader. Fluorescence, shown in columns J-L, was measured at Ex/Em of 488/518 nm, and is a measure of expression of the open reading frame (ORF) encoding fluorescent reporter DasherGFP from stably integrated transposons.

Table 6 shows that co-transfection of a transposon with *Bombyx* transposon ends (each comprising SEQ ID NO: 33) together with mRNA encoding a *Bombyx* transposase fused to a heterologous NLS, resulted in up to 100× increases in expression relative to the cells transfected with transposon alone, and comparable to the expression enhancement obtained when the transposase was provided encoded in DNA (compare rows 5-8 with rows 9-11 and row 4. Also compare rows 13-16 with rows 17-19 and row 12). Thus a *Bombyx* transposase may be provided as mRNA that can be translated in the target cell.

6.1.3.3 Hyperactive *Xenopus* Transposase mRNA

It is advantageous to provide a transposase as expressible RNA, since this avoids any possibility that the transposase gene may be integrated into the target genome. Messenger RNA encoding hyperactive *Xenopus* transposases, SEQ ID NO: 168, 189 and 175, fused to a heterologous NLS were prepared by in vitro transcription using T7 RNA polymerase as described in Section 4.2.3.

A transposon comprised 5'-TTAA-3' target sequences, transposon end sequences SEQ ID Nos: 2 and 12, and a CMV enhancer and CMV promoter operably linked to a gene encoding DasherGFP. The transposon also comprised the murine phosphoglycerate kinase (PGK) promoter, SEQ ID NO: 937, operably linked to a gene encoding puromycin N-acetyl transferase.

The transposon was transfected into CHO-S suspension cells together with polynucleotides encoding transposases whose SEQ ID NO is shown in column C of Table 12. The amount of transposase mRNA per transfection is indicated in column F. The amount of each transposon DNA in each transfection is shown in column E of Table 12.

CHO-S cells were transfected as described in Section 4.2.2. Puromycin (50 µg/ml) selection was carried out for 10 days, and cells were grown for 5 days post puromycin selection with two passages and changes of media. Cells were harvested by pipetting directly into a fluorimetric plate and measured in a fluorimetric plate reader. Fluorescence was measured at Ex/Em of 488/518 nm, and is a measure of expression of the ORF encoding fluorescent reporter DasherGFP from stably integrated transposons.

Table 12 shows that there was no significant difference in fluorescence between samples at 72 hours post-transfection. However, after 10 days of puromycin treatment, fluorescence from all transposons that had been co-transfected with a hyperactive transposase mRNA was between 5 and 30-fold brighter than from transposons co-transfected with mRNA encoding natural *Xenopus* transposase SEQ ID NO: 48. After 5 days of recovery, all hyperactive transposase co-transfections were still outperforming SEQ ID NO: 48. Thus hyperactive transposases identified using a functional screen in *Saccharomyces cerevisiae* lead to reduced recovery times and increased expression from transposons in mammalian cells, and hyperactive *Xenopus* transposases may be provided as mRNA that can be translated in the target cell.

6.1.3.4 Hyperactive *Xenopus* and *Bombyx* Transposase mRNA

Messenger RNA encoding hyperactive *Xenopus* transposases SEQ ID NO: 175 and 189, fused to a heterologous NLS, or *Bombyx* transposases SEQ ID NO: 407 and 1098 were prepared by in vitro transcription using T7 RNA polymerase as described in Section 4.2.3.

Transposons comprised transposon end sequences with SEQ ID NOs given in columns B and C of Table 13. The transposons further comprised a CMV enhancer and CMV promoter operably linked to a gene encoding DasherGFP, and a gene encoding puromycin acetyl transferase operably linked to a promoter with SEQ ID NO shown in column F. Transposons (750 ng) were co-transfected with 250 ng mRNA encoding a transposase with SEQ ID NO shown in column G, fused to a heterologous nuclear localization signal.

CHO-S cells (from ATCC) were transfected as described in Section 4.2.2. Puromycin (10 µg/ml) selection was carried out for 10 days, with a complete media change into fresh puromycin-containing media after 5 days. After 10 days, cells were transferred to fresh media containing 25 µg/ml puromycin for 4 days. Cells were grown for 5 days post puromycin selection with two passages and changes of media. Cells were harvested by pipetting directly into a fluorimetric plate and measured in a fluorimetric plate reader. Fluorescence was measured at Ex/Em of 488/518 nm, and is a measure of expression of the ORF encoding fluorescent reporter DasherGFP from stably integrated transposons, triplicate measurements are shown in columns H-J of Table 13.

Table 13 shows that mRNAs encoding hyperactive *Xenopus* or *Bombyx* transposases are active on their respective transposons.

6.2 Polynucleotide Constructs for Expression of Multiple Proteins 6.2.1 Transposons with Dual Promoter or IRES Configurations (1)

Transposons and transposases may be used to efficiently integrate polynucleotide constructs encoding two or more polypeptides into the genome of a cell. Transposons are useful for this purpose because a transposase will usually integrate all of the DNA between the two transposon ends during the transposition process. This means that sequence elements that are configured to achieve a specific ratio of expression between the different encoded genes are more likely to be preserved, than if random fragments of the polynucleotide are inserted into the genome of the target cell. It also means that all of the encoded genes will be integrated at each integration event which is useful with larger polynucleotide constructs.

Table 7 shows the configurations of a set of transposons comprising 5'-TTAA-3' target sequences and transposon ends SEQ ID NOS: 2 and 12. Transposons comprised genes encoding DasherGFP and CayenneRFP, except for rows 1 and 2 in which only one fluorescent protein was present (columns C and D). When both fluorescent protein genes were present, the DasherGFP gene always occurred first. All of the transposons also comprised a puromycin resistance gene operably linked to the PGK promoter and transcribed in the opposite direction to the genes for the fluorescent proteins. All of the transposons also comprised a pair of HS4 insulators, one adjacent to each transposon end. In some configurations (rows 8-23) the two genes were each operably linked to separate promoters and polyadenylation signals, in some configurations the genes were operably linked to a single promoter preceding the first gene and a single polyA signal following the second gene, where the two genes were operably linked by an IRES sequence or a CHYSEL sequence. The transposons comprised the SEQ ID NO given in column A between the first and second open reading frames. Regulatory elements associated with each gene are shown in columns E-L of Table 7. The number 1 in the headers indicates promoters preceding or polyA signals following the first gene, the number 2 in the headers indicates promoters preceding or polyA signals following the second gene. All of these sequences further comprised expression enhancing sequence SEQ ID NO: 866 sequence preceding the last polyadenylation signal. Transposons were transfected into CHO cells together with a gene encoding a transposase (SEQ ID NO: 48) fused to a nuclear localization signal, operably linked to the CMV promoter. CHO cells were transfected and selected as described in Section 4.2.1. Fluorescence represents expression of the ORFs encoding fluorescent reporter DasherGFP from stably integrated transposons measured at Ex/Em of 488/518 nm and CayenneRFP was measured at Ex/Em of 525/580 nm. Mean fluorescence from triplicate independent transfections are shown in Table 7 columns M and N respectively.

Column O in Table 7 shows the ratio of red to green fluorescence obtained for each transposon. Because the two fluorescent proteins fluoresce with different intensities, this is not a measurement of the ratios of concentration of the two proteins. Row 3 shows the fluorescence obtained when the two proteins are coupled by a CHYSEL sequence. This produces close to equimolar amounts of the two proteins, and gives a red to green fluorescence ratio of 0.21. Column P shows the red to green ratios of column O, normalized by dividing by 0.21, to obtain the ratio at which the two proteins are expressed. Column Q shows the expression of DasherGFP relative to the expression when DasherGFP is the only encoded fluorescent protein.

Coupling the translation of two open reading frames through IRES SEQ ID NOS: 1062-1064 produced very high levels of expression of the first encoded protein (at least 70% of the amount of protein obtained from a monocistronic construct, compare row 2 with rows 4-7). These constructs also produced the second encoded protein at between 0.33 and 0.48 the levels of the first. Ratios or 1:0.33 to 1:0.48 are very good for production of light and heavy chains of antibodies respectively. Thus IRES SEQ ID NOS: 1062-1064 are preferred components of polynucleotide constructs for the efficient production of antibodies.

Another way to obtain expression of two genes from one polynucleotide is to operably link each gene to a separate promoter. Rows 8-23 of Table 7 show a variety of different configurations for the regulatory elements associated with the second open reading frame. In general, the expression of the first encoded protein was less in these constructs than in the IRES-coupled constructs (column Q). However, a greater range of expressions of the second encoded gene were obtained (column P). Expression of one gene and often both genes was substantially increased if an HS4 core insulator (SEQ ID NO: 865) was interposed between the polyadenylation sequence operably linked to the first open reading frame, and the promoter operably linked to the second open reading frame (compare rows 14 and 15, rows 16 and 17, rows 18 and 19, rows 20 and 21, rows 22 and 23, and rows 12 and 13). The placement of an insulator sequence such as the HS4 core insulator sequence between a polyadenylation sequence operably linked to a first open reading frame, and a promoter operably linked to a second open reading frame, is thus a preferred configuration for expressing two genes from the same polynucleotide.

Advantageous vector configurations for the expression of two polypeptides include those in which a gene encoding a first polypeptide is operably linked to control elements including an EF1 intron from one species, and a gene encoding a second polypeptide is operably linked to control elements including an EF1 intron from a second species. Advantageous vector configurations for the expression of two polypeptides include those in which a gene encoding a first polypeptide is operably linked to control elements including an EF1 promoter from one species, and a gene encoding a second polypeptide is operably linked to control elements including an EF1 promoter from a second species. Advantageous vector configurations for the expression of two polypeptides include those in which a gene encoding a first polypeptide is operably linked to control elements including a human CMV promoter, and a gene encoding a second polypeptide is operably linked to control elements including a murine CMV promoter.

Advantageous vector configurations for the expression of two polypeptides include those in which a gene encoding a first polypeptide is operably linked to control elements including a sequence that is at least 95% identical to a sequence selected from SEQ ID NO: 1015, 1019, 1022, 1026, 1027, 1028, 1029 or 1099.

6.2.2 Transposons with Dual Promoter or IRES Configurations (2)

Configurations of a set of transposons comprising genes encoding DasherGFP and/or CayenneRFP are indicated in Table 8 (columns D and E). When both fluorescent protein genes were present, the DasherGFP gene always occurred first. All of the transposons also comprised a puromycin resistance gene operably linked to the PGK promoter and transcribed in the opposite direction to the genes for the fluorescent proteins. Two of the transposons (Transposons 188209 and 188219, column B) also comprised a pair of HS4 insulators, one adjacent to each transposon end. In some configurations the two genes were each operably linked to separate promoters and polyadenylation signals, in some configurations the genes were operably linked to a single promoter preceding the first gene and a single polyA signal following the second gene, where the two genes are operably linked by an IRES sequence or a CHYSEL sequence. The number 1 indicates promoters preceding or polyA signals following the first gene, the number 2 indicates promoters preceding or polyA signals following the second gene. All of these sequences further comprised expression enhancing sequence SEQ ID NO: 866 preceding the last polyadenylation signal. Transposons were transfected into CHO cells plus or minus a gene encoding a transposase (SEQ ID NO: 48) fused to a nuclear localization signal, operably linked to the CMV promoter (column O).

CHO-K1 cells were transfected and selected as described in Section 4.2.1. Fluorescence represents expression of the ORFs encoding fluorescent reporter DasherGFP from stably integrated transposons measured at Ex/Em of 488/518 nm and CayenneRFP was measured at Ex/Em of 525/580 nm (Table 8 columns P-U)

Co-transfection of transposons with the vector encoding the transposase increased expression of both proteins encoded by the transposon between 4-fold and nearly 20-fold relative to transfections with the transposon alone. Expression of two polypeptides from a transposon are improved by the activity of a transposase. The best expressing transposons comprised flanking HS4 insulators, and expression of the two polypeptides coupled by an IRES. These are thus preferred configurations for transposons for expression of two polypeptides.

6.3 Modified Transposases

6.3.1 Hyperactive *Xenopus* Transposases 6.3.1.1 Identification of Hyperactive *Xenopus* Transposases To identify *Xenopus* transposase mutations that led to either increased transposition activity, or increased excision activity, relative to the naturally occurring transposase sequence SEQ ID NO: 48, we first created libraries that together contained all possible single amino acid changes from SEQ ID NO: 48, fused to a heterologous nuclear localization sequence. To do this, a gene encoding *Xenopus* transposase fused to a heterologous nuclear localization sequence (SEQ ID NO: 50) was amplified by PCR, using degenerate primers to incorporate all possible amino acids at a single position. This "site-saturation" library was cloned into a vector comprising a leucine selectable marker; genes encoding the transposase mutants were operably linked to the *Saccharomyces cerevisiae* Gal-1 promoter. One library was created for each of the 589 amino acids in the transposase. Each library was sequenced across the mutagenized position to ensure that no unintended mutations had been introduced, and that the targeted codon was indeed mutated.

The cloned libraries were then pooled, each pool comprising libraries for six adjacent amino acid positions, i.e. amino acids 1-6, 7-12, 13-18 etc. Each library pool was then transformed into *Saccharomyces cerevisiae* cells that were carrying a genomically integrated *Xenopus* transposon selection cassette, and plated on minimal complete media lacking leucine to select for transformants carrying the leucine selectable marker.

The *Xenopus* transposon selection cassette (SEQ ID NO: 44) comprised the *Saccharomyces cerevisiae* URA3 promoter followed by a gene encoding the first part of the *Saccharomyces cerevisiae* URA3 protein. The URA3 protein was interrupted at a TTAA sequence within its coding region by a transposon insert comprising *Xenopus* left transposon end SEQ ID NO: 2, the TEF promoter from *Ashbya gossypii*, an open reading frame encoding the *Saccharomyces cerevisiae* TRP 1 protein, the TEF terminator from *Ashbya gossypii* and *Xenopus* right transposon end SEQ ID NO: 12. On the other side of the transposon insert was a DNA sequence encoding the remainder of the *Saccharomyces cerevisiae* URA3 protein, followed by the *Saccharomyces cerevisiae* URA3 terminator. The transposon was inserted such that the TTAA sequence was present at both ends, and removal of the transposon to leave a single copy of this TTAA would result in a complete and functional gene encoding the *Saccharomyces cerevisiae* URA3 protein.

Two days after plating, transformed *Saccharomyces cerevisiae* cells were harvested by adding 5 ml sterile water to each plate, and gently scraping to resuspend the cells. Cells were combined into pools representing 60 adjacent amino acids, i.e. 1-60, 61-120, 121-180 etc. The $A_{600}$ of each pool was measured, and used to estimate the concentration of live cells. Plasmid DNA was prepared from a portion of each pool for sequencing. This was to determine the frequency of each amino acid change in the naïve (unselected) library. The cells were then selected under 3 different regimes.

Selection 1: $2 \times 10^8$ cells from each pool were transferred to minimal media minus leucine containing 2% galactose, and grown for 4 hours at 30° C. Cells were then plated onto minimal complete media lacking uracil, tryptophan and leucine. Two days after plating, transformed *Saccharomyces cerevisiae* cells were harvested by adding 5 ml sterile water to each plate, and gently scraping to resuspend the cells. Plasmid DNA was prepared to determine the frequency of each amino acid change in the selected library.

Selection 2: $2 \times 10^8$ cells from each pool were transferred to minimal media minus leucine containing 2% galactose, and grown for 20 hours at 30° C. Cells were then plated onto minimal complete media lacking uracil, tryptophan and leucine. Two days after plating, transformed *Saccharomyces cerevisiae* cells were harvested by adding 5 ml sterile water to each plate, and gently scraping to resuspend the cells. Plasmid DNA was prepared to determine the frequency of each amino acid change in the selected library.

Selection 3: $2 \times 10^8$ cells from each pool were transferred to minimal media minus leucine containing 2% galactose, and grown for 20 hours at 30° C. Cells were then plated onto minimal complete media lacking uracil, and leucine, and containing 0.5 g/L 5-fluoroanthranilic acid. Five days after plating, transformed *Saccharomyces cerevisiae* cells were harvested by adding 5 ml sterile water to each plate, and gently scraping to resuspend the cells. Plasmid DNA was prepared to determine the frequency of each amino acid change in the selected library.

Selections 1 and 2 identified cells in which the transposase had precisely excised the transposon from the uracil gene (so the cells are URA+) and re-integrated into another site in the genome (so the cells were TRP+). Selection 3 identified cells in which the transposase had precisely excised the transposon from the uracil gene (so the cells were URA+) but not re-integrated into another site in the genome (so the cells were TRP− and resistant to 5-fluoroanthranilic acid).

The mutated transposase genes from the naïve library and each of the selected libraries were sequenced using an Illumina HiSeq. Mutation frequencies from the naïve library were compared with the frequencies in the selected libraries. Mutations that were more highly represented in libraries selected under conditions 1 or 2, compared with the naïve library, were those that increase the transpositional activity of the transposase. Mutations that were more highly represented in the library selected under condition 3, compared with the naïve library, were those that increase the excision activity of the transposase. Operability of a *Xenopus* transposase can be shown by the ability of the transposase, when fused to a heterologous NLS, to excise the transposon from within SEQ ID NO: 44, and, except in the case of an integration-deficient transposase, to integrate the transposon into the genomic DNA of a target cell.

Table 4 shows the amino acid substitutions that were represented at least 2 times more frequently in the selected library than in the naïve library. The data was processed as follows. Considering each amino acid change independently, any amino acid substitution that occurred in the naïve library less than once for each 200 substitutions observed at that position, was discarded from further consideration. Any amino acid substitution that was observed fewer than 100 times in the selected library was discarded from further consideration. The frequency of each substitution in each selected library was then calculated relative to the frequency that the substitution occurred in the naïve library. Substitutions that occurred at least twice as frequently in a library selected for transposition, compared with their frequency in the naïve library are shown in Table 4 column C. Substitutions that occurred at least twice as frequently in a library selected for excision, compared with their frequency in the naïve library are shown in Table 4 column D.

Some of the amino acid substitutions shown in Table 4 were selected for incorporation into variant *Xenopus* transposases to create hyperactive variants. Initially, a set of 95 variants of transposase SEQ ID NO: 48 were created by selecting 57 of the substitutions shown in Table 4, and incorporating 3 of these into each of 95 variants, such that the number of possible pairs is maximized and each substitution occurs 5 times in the set of variants. The transposases were cloned into a vector comprising a leucine selectable marker, so that the transposase variants were operably linked to the *Saccharomyces cerevisiae* Gal-1 promoter. Each of these variants was then individually transformed into a *Saccharomyces cerevisiae* strain carrying a chromosomally integrated copy of SEQ ID NO: 44, as described above. The variants were induced with galactose, grown for 4 hours, then aliquots were plated (a) on media lacking leucine, uracil and tryptophan (to count integration), (b) on media lacking leucine and uracil (to count excision) and (c) on media lacking leucine (to count total live cells). Two days later, colonies were counted to determine transposition (=number of cells on -leu-ura-trp media divided by number of cells on -leu media) and excision (=number of cells on -leu-ura media divided by number of cells on -leu media) frequencies.

Transposition frequencies were modelled as described in U.S. Pat. No. 8,635,029, and mean values and standard deviations for the regression weights were calculated for each substitution. Subsequent sets of variants were designed incorporating more than 3 substitutions relative to the sequence of SEQ ID NO: 48. These variants combined two or more substitutions with regression weights greater than one standard deviation above zero. The variants optionally also comprised one or more substitution selected from column C or D in Table 4. New variants were tested as described above to measure transposition and/or excision frequencies for the new variant transposases. Regression weights and standard deviations for substitutions with a positive effect on transposition activity are shown in Table 11 columns D and E. Transposition frequencies for some hyperactive *Xenopus* transposases are shown in Table 14 columns A and B. Frequencies were measured for excision of the transposon from reporter SEQ ID NO: 44 and integration of that transposon into the *Saccharomyces cerevisiae* genome, and are expressed relative to the transposition frequencies measured for the naturally occurring sequence SEQ ID NO: 48 under identical conditions.

Transposases with SEQ ID NOS: 51 and 403-406 were found to have excision frequencies that were at least 10-fold higher than their integration frequencies. Transposases in which the amino acid at position 218 was changed from Asn to either Asp or Glu also showed much higher excision than integration frequencies. These integration-deficient transposases are thus useful for removing integrated transposons from a host genome.

6.3.1.2 Hyperactive *Xenopus* Transposases in Mammalian Cells

The ability of several hyperactive *Xenopus* transposases to integrate three different transposon configurations into the CHO genome was tested. Transposon configurations are shown in Table 16.

Transposons (750 ng) were co-transfected with polynucleotides encoding *Xenopus* transposases fused to a heterologous nuclear localization signal. Transposon and transposase nucleic acids were transfected into 1 ml of suspension-adapted CHO cells. Cells were grown for 72 hours post-transfection and then diluted to 250,000 cells per ml in 40 µg/ml puromycin for 8 days. The puromycin was removed and cells were grown for a further 7 days. Expression of Dasher GFP was measured in a plate fluorimeter (excitation at 485 nm and emission measured at 515 nm).

This selection is highly stringent: the puromycin acetyl transferase gene is operably linked with a weak promoter, and the cells were diluted to low levels into high levels of puromycin. In all cases under these stringent conditions, the absence of transposase (Table 16 rows 3, 6 and 9) or co-transfection of *Xenopus* transposons with naturally occurring *Xenopus* transposase SEQ ID NO: 48 (Table 16 rows 1, 4 and 7), resulted in essentially complete cell death and very low levels of DasherGFP expression. In contrast co-transfection of *Xenopus* transposons with hyperactive *Xenopus* transposases SEQ ID NOs: 57, 58 and 61 resulted in pools with high levels of DasherGFP expression (Table 16 rows 2, 5 and 8). It is thus advantageous to co-transfect mammalian cells with *Xenopus* transposons and hyperactive *Xenopus* transposases, including SEQ ID NOS: 57, 58 and 61.

6.3.2 Hyperactive *Bombyx* Transposases 6.3.2.1 Identification of Hyperactive *Bombyx* Transposases To identify *Bombyx* transposase mutations that led to either increased transposition activity, or increased excision activity, relative to naturally occurring sequence SEQ ID NO: 407, we first created libraries that together contained all possible single amino acid changes from SEQ ID NO: 407, fused to a heterologous nuclear localization sequence. To do this, a gene encoding *Bombyx* transposase fused to a heterologous nuclear localization sequence (SEQ ID NO: 408) was mutagenized, cloned and sequenced as described for the *Xenopus* transposase in Section 6.3.2.1.

The cloned libraries were pooled and transformed into *Saccharomyces cerevisiae* cells which were carrying a genomically integrated *Bombyx* transposon selection cassette as described for the *Xenopus* transposase in Section 6.3.1.

The *Bombyx* transposon selection cassette (SEQ ID NO: 47) was as described for the *Xenopus* cassette SEQ ID NO: 44 in Section 6.3.1, except that the *Xenopus* transposon ends SEQ ID NO 2 and 12 were replaced by *Bombyx* transposon end sequences SEQ ID NO 22 and 30 respectively. Operability of a *Bombyx* transposase can be shown by the ability of the transposase, when fused to a heterologous NLS, to excise the transposon from within SEQ ID NO: 47, and, except in the case of an integration-deficient transposase, to integrate the transposon into the genomic DNA of a target cell.

The *Bombyx* transposase mutant libraries were selected, sequenced and processed, as described for the *Xenopus* transposase libraries in section 6.3.1. Substitutions that occurred at least twice as frequently in a *Bombyx* library selected for transposition, compared with their frequency in the naïve library are shown in Table 4 column G. Substitutions that occurred at least twice as frequently in a *Bombyx* library selected for excision, compared with their frequency in the naïve library are shown in Table 4 column H.

Some of the amino acid substitutions shown in Table 4 were selected for incorporation into *Bombyx* transposase SEQ ID NO: 407 to create hyperactive variants, as described for the *Xenopus* transposase in Section 6.3.1 but using a *Saccharomyces cerevisiae* strain carrying a chromosomally integrated copy of SEQ ID NO: 47 in place of SEQ ID NO: 44.

Subsequent sets of variants were designed incorporating more than 3 substitutions relative to the sequence of SEQ ID NO: 407. These variants combined two or more substitutions with regression weights greater than one standard deviation above zero. The variants optionally also comprised one or more substitution selected from column G or H in Table 4. New variants were tested as described above to measure transposition and/or excision frequencies for the new variant transposases. The regression weights and standard deviations for substitutions with a positive effect on transposition activity are shown in Table 11 columns I and J. Transposition frequencies for different hyperactive *Bombyx* transposases are shown in Table14 columns C and D. Frequencies were measured for excision of the transposon from reporter SEQ ID NO: 47 and integration of that transposon into the *Saccharomyces cerevisiae* genome, and are expressed relative to the frequencies for the naturally occurring sequence SEQ ID NO: 407 under identical conditions.

6.3.2.2 Hyperactive *Bombyx* Transposases in Mammalian Cells

The ability of several hyperactive *Bombyx* transposases to integrate four different transposon configurations into the CHO genome was tested. Transposon configurations are shown in Table 15. Transposon 194094 comprised a PGK promoter (SEQ ID NO: 937) operably linked to a puromycin acetyl transferase gene and a CMV promoter operably linked to a gene encoding Dasher GFP. Transposon 240671 was the same as 194094, except that the transposon end sequences were different, as shown in Table 15. Transposon 246143 was the same as 240671, except that the PGK promoter was replaced with the HSV-TK promoter SEQ ID NO: 942. Transposon 246170 was similar to 246143, but it had the EF1a promoter operably linked to the gene encoding Dasher GFP, it is also flanked by insulator sequences (HS4 insulator SEQ ID NO: 864 on one side and D4Z4 insulator SEQ ID NO: 860 on the other.

Transposons (750 ng) were co-transfected with polynucleotides encoding a transposase with SEQ ID NO shown in column K, fused to a heterologous nuclear localization signal. Transposon and transposase nucleic acids were transfected into 1 ml of suspension-adapted CHO cells. Cells were grown for 72 hours post-transfection and then diluted to 1,000,000 cells per ml in 40 µg/ml puromycin for 7 days. The puromycin was removed and cells were grown for a further 7 days. Expression of Dasher GFP was measured in a plate fluorimeter (excitation at 485 nm and emission measured at 515 nm) (Table 15 columns O-Q). An estimate of live cell numbers was made by measuring absorbance at 600 nm ($A_{600}$) (Table 15 columns L-N).

In all cases, the absence of transposase resulted in very low levels of DasherGFP expression, and very low $A_{600}$ indicating a lack of expression of puromycin acetyl transferase and cell survival (rows 8, 16, 24 and 32). All transposases resulted in comparable levels of cell survival for cells co-transfected with transposons 194094 and 240671 (compare Table 15 columns L, M and N for rows 1-7 and 9-15). However, the hyperactive transposases resulted in significantly increased levels of DasherGFP expression (compare Table 15 columns O, P and Q for rows 1-7 and 9-15). It is thus advantageous to co-transfect mammalian cells with *Bombyx* transposons and hyperactive *Bombyx* transposases, including SEQ ID NOS: 1098, 412, 457 and 415-417.

Cells transfected with transposon 246143 all died under the selection conditions used, regardless of which transposase was co-transfected (Table 15 columns L, M, N, O, P and Q for rows 17-24). However, cells transfected with transposon 246170 and co-transfected with hyperactive *Bombyx* transposases, SEQ ID NOS: 1098, 412 and 415-417, all resulted in cells with Dasher GFP fluorescence. No cells survived when this transposon was co-transfected with the naturally occurring *Bombyx* transposase (SEQ ID NO: 407). Hyperactive *Bombyx* transposases, SEQ ID NOS: 412 and 415 were particularly advantageous in combination with this transposon configuration.

Transposon configuration, selection stringency and transposase activity are interdependent in determining the expression level that results from the subsequently integrated transposon. The promoter that is operably linked to an expression polypeptide (in this example DasherGFP) can also modify the strength of the promoter that is operably linked to the selectable marker and. As described in Section 5.2.10, a strong promoter operably linked to the resistance marker (as in transposon 240671) will provide the least stringent selection, while a weak promoter operably linked to the resistance marker (as in transposon 246143) will provide a more stringent selection, particularly in combination with an interfering promoter operably linked with the expression polypeptide.

The benefit of a more stringent selection coupled with a hyperactive transposase is shown here. Hyperactive *Bombyx* transposase SEQ ID NOS: 412 and 415 each produced a pool of cells with substantially higher expression of the expression polypeptide from transposon 246170 than was achieved from transposons with the stronger promoter associated with the selectable marker (compare row 9 column O with row 25 column O and row 26 column Q). Furthermore, the productivity of the cells from the more stringently selected transposon (expression divided by number of live cells, which is approximately proportional to fluorescence divided by $A_{600}$) is about 10-fold higher than for the less stringently selected transposon.

Although the relative integration frequencies of hyperactive transposases shown in Table 14 give a quantitative comparison of transposase activity, increased transposase activity alone is not sufficient to guarantee increase expression resulting from transposons integrated into a target cell genome. As shown in this example, the transposon configuration and the selection stringency are both factors that influence expression of an expression polynucleotide. In particular the gene encoding the selectable marker, the promoter (and other regulatory elements) operably linked to the selectable marker, the promoter operably linked to the gene encoding the expression polypeptide and any insulator elements present are important determinants of expression from a gene transfer polynucleotide. Particularly advantageous gene transfer polynucleotides comprise a sequence that is at least 95% identical to a sequence selected from SEQ ID NOS: 751-819. Preferably these sequences are within a transposon.

The data shown in Table 15 shows only the average fluorescence within a pool of cells. These pools were derived from many independently transfected cells. Each of these will give rise to a different transposon integration pattern (number of transposons integrated and position of each of these transposons within the target cell genome). Individual lines can be isolated from a pool of cells like this, and some of these often have substantially higher productivities than the pool.

6.4 IRES Elements 6.4.1 Expression Levels of Two Polypeptides Using IRES Elements in HEK293 and CHO Cells A gene transfer system comprising genes encoding two polypeptides may operably link both polypeptides to the same promoter, for example using an IRES.

Table 9 shows the expression levels observed in HEK and CHO cells for two different polypeptides (in this case two different fluorescent proteins, DasherGFP and CayenneRFP) encoded on a single gene transfer polynucleotide. The genes for the two different proteins were operably linked to a single enhancer, promoter, polyadenylation signal and optionally an intron. Expression of the two genes was operably linked by an IRES element, as indicated in column A, with the order of elements being DasherGFP-IRES-CayenneRFP.

HEK 293a cells (from ATCC) were grown in EMEM (from ATCC)+10% FBS (from ATCC)+1% Penicillin-streptomycin (from ATCC) at 37° C., 5% $CO_2$ to 80% confluence, 1E+05 cells were plated in 24-well tissue culture plates and incubated at 37° C., 5% $CO_2$ for 24 hours prior to transfection, transfections were set up in triplicates. Each transfection used 0.5 µg DNA with Lipofectamine 2000 as per manufacturer's protocol. Cells were harvested 72 hours post transfection. CHO-K1 cells (from ATCC) were grown in F12-K (from ATCC)+10% FBS (from ATCC)+1% Penicillin-streptomycin (from ATCC) at 37° C., 5% $CO_2$ to 80% confluence. 5E+05 cells were plated in 24-well tissue culture plates and incubated at 37° C., 5% $CO_2$ for 24 hours prior to transfection, transfections were set up in triplicates. Each transfection used 0.5 µg DNA with Lipofectamine 2000 as per manufacturer's protocol. Cells were harvested 72 hours post transfection. Fluorescence of the two ORFs encoding fluorescent reporters DasherGFP and CayenneRFP was measured at Ex/Em of 488/518 nm for DasherGFP and Ex/Em of 525/580 nm for CayenneRFP.

A gene transfer polynucleotide comprising the two proteins translationally coupled by a CHYSEL sequence expresses the two proteins at an equimolar ratio and was used to normalize for different fluorescent intensities of the proteins. Table 9 shows that different IRES elements can be used to obtain different ratios of expression between two different polynucleotides. The use of IRES elements is particularly advantageous for expression of polypeptides when the ratio of expression is important at the level of individual cells, for example in the expression of antibodies where the light chain may perform a chaperonin function for the heavy chain. It is sometimes advantageous to express as great a ratio as possible between two polypeptides, for example in the case when one polypeptide is a selectable marker.

We have identified IRES elements that show different levels of activity as seen from the varying expression levels for the two open reading frames (ORFs) linked by an IRES element shown in Table 9. A choice of IRES elements with varying activities allows the appropriate IRES element to be used for controlling the relative expression levels of two ORFs. We have shown use of one IRES element linking two transcripts operably linked to one promoter. Use of two or more IRES elements linking three or more ORFs is expressly contemplated and is another aspect of the invention. Expression constructs with two or more IRES elements selected such that expression levels of two or more ORFs is selectively modulated is expressly contemplated and is an important aspect of the invention. The identified IRES elements of the invention work well in both transient and stable integration vectors in the two cell lines tested, Human embryonic kidney (HEK293) cells and Chinese hamster ovary (CHO) cells. Preferred embodiments of a gene transfer polynucleotide include all IRES elements shown in Table 9.

6.5 Transposase Activity in Yeast 6.5.1 Transposons in *Pichia Pastoris*

To integrate a polynucleotide into the genome of *Pichia pastoris*, it is generally necessary to linearize a gene transfer construct prior to transformation. It is advantageous if the ends of the linear gene transfer construct are homologous to neighboring sequences in the *Pichia pastoris* genome, so that the construct may be integrated into the chromosome by homologous recombination. Such gene transfer constructs generally comprise a gene encoding a selectable marker (for example resistance to zeocin (e.g. SEQ ID NO: 702), nourseothricin (e.g. SEQ ID NO: 701) or geneticin (e.g. SEQ ID NO: 706). High levels of expression may be obtained by exposing cells to high levels of the corresponding selection agent, which results in amplification of the gene. The amplification is usually achieved by tandem duplication of the gene, which is an inherently unstable arrangement. Because transposons integrate almost randomly throughout the target genome, they offer the advantage of high expression resulting from multiple inserted copies, while improving stability because the copies are distributed throughout the genome.

Three transposons were constructed for modifying the genome of *Pichia pastoris*, and comprised transposon ends SEQ ID NOs: 2 and 12 flanking a heterologous polynucleotide. The heterologous polynucleotide comprised an AOX promoter (SEQ ID NO: 953) operably linked to a gene encoding Dasher GFP (SEQ ID NO: 42), and an ILV5 promoter (SEQ ID NO: 955) operably linked to a gene encoding zeocin resistance (SEQ ID NO: 702). One of these transposons (251587) was carried on a plasmid that comprised the GAP promoter SEQ ID NO: 949 operably linked to a gene encoding *Xenopus* transposase SEQ ID NO: 118; a second transposon (251588) was carried on a plasmid that comprised the TEF promoter SEQ ID NO: 954 operably linked to a gene encoding *Xenopus* transposase SEQ ID NO: 118; a third transposon (251589) was carried on a plasmid with no transposase. All transposases were part of the non-transposable portion of the plasmid.

The three transposons were transformed as supercoiled circular DNA into competent *Pichia pastoris* cells by electroporation (using a Bio-Rad *E. coli* Pulser in cuvettes with a 0.2 cm gap, and 1.5 kV). In addition, transposon 251589 (whose plasmid lacked a transposase entirely) was electroporated after linearization with PmeI, which cuts within the AOX promoter. After electroporation the cells were grown in non-selective media (900 µl YPD broth plus 1M sorbitol) for 5 or 24 hours at 30° C., before 100 µl culture was plated onto 200 µg/ml zeocin and plates incubated at 30° C. for 48 hours. The number of zeocin resistant colonies on each plate were counted, and are shown in Table 10 (columns E and F).

Without linearization, very few colonies were formed in the absence of a transposase (rows 9-11). By contrast, linearization prior to electroporation resulted in approximately 1,000 colonies from 100 µl culture (row 12). Similarly, the expression of Xenopus transposase SEQ ID NO: 118, either transcribed from the GAP promoter (rows 3-5) or the TEF promoter (rows 6-8) resulted in tens to hundreds of colonies. Xenopus transposons and transposases are thus useful for integrating gene transfer constructs into the genome of the yeast Pichia pastoris.

BRIEF DESCRIPTION OF TABLES

Table 1. Integration of Transposons Catalyzed by Modified Transposases with or without Heterologous Nuclear Localization Signals.

Transposons and transposases were transfected into CHO-K1 cells and selected as described in Example 6.1.1. Fluorescence was measured by scraping cells and placing in a fluorimeter. Fluorescent readings obtained in independent triplicate transfections are shown in columns J-L. Columns A, B and F refer to SEQ ID NOs.

Table 2. Integration of Transposons with Modified Transposon Ends.

Transposons and transposases were transfected into CHO-K1 cells and selected as described in Example 6.1.2.1. Fluorescence was measured by scraping cells and placing in a fluorimeter. Fluorescent readings obtained in independent triplicate transfections are shown in columns J-L. Columns A, B and G refer to SEQ ID NOs.

Table 3. Integration of Transposons with Modified Transposon Ends.

Transposons and transposases were transfected into CHO-K1 cells and selected as described in Example 6.1.2.2. Fluorescence was measured by scraping cells and placing in a fluorimeter. Fluorescent readings obtained in independent triplicate transfections are shown in columns J-L. Columns A, B and G refer to SEQ ID NOs.

Table 4. Substitutions in Transposases Associated with Hyperactivity.

Mutant Xenopus and Bombyx transposases were produced, selected and sequenced as described in Examples 6.3.1.1 and 6.3.2.1. Positions relative to Xenopus transposase SEQ ID NO: 48 are shown in column A; the naturally occurring amino acid is in column B; substitutions that occurred at least twice as frequently in a Xenopus library selected for transposition, compared with their frequency in the naïve library are shown in column C; substitutions that occurred at least twice as frequently in a Xenopus library selected for excision, compared with their frequency in the naïve library are shown in column D. Positions relative to Bombyx transposase SEQ ID NO: 407 are shown in column E; the naturally occurring amino acid is in column F; substitutions that occurred at least twice as frequently in a Bombyx library selected for transposition, compared with their frequency in the naïve library are shown in column G; substitutions that occurred at least twice as frequently in a Bombyx library selected for excision, compared with their frequency in the naïve library are shown in column H. Positions in the two transposases sharing a line in the table do not correspond to a sequence alignment between the two proteins.

Table 5. Integration of Transposons Using Transposase mRNA.

Transposons and transposases were transfected into CHO-K1 cells and selected as described in Example 6.1.3.1. Fluorescence was measured by scraping cells and placing in a fluorimeter. Fluorescent readings obtained in independent triplicate transfections are shown in columns J-L. Columns A, B and E refer to SEQ ID NOs.

Table 6. Integration of Transposons Using Transposase mRNA.

Transposons and transposases were transfected into CHO-K1 cells and selected as described in Example 6.1.3.3. Fluorescence was measured by scraping cells and placing in a fluorimeter. Fluorescent readings obtained in independent triplicate transfections are shown in columns J-L. Columns A, B, C and F refer to SEQ ID NOs.

Table 7. Integration of Xenopus-Derived Transposons for Expression of Two Polypeptides.

Transposons comprised 5'-TTAA-3' target sequences, transposon end sequences SEQ ID NO: 2 and SEQ ID NO: 12, and the EF1a promoter and intron operably linked to a gene encoding DasherGFP (rows 2-23) or CayenneRFP (row 1). For rows 3-7, vectors further comprised a gene encoding CayenneRFP operably linked to the expression control elements by a translational-coupling sequence (SEQ ID NO given in column A). For rows 8-23, vectors further comprised a gene encoding Cayenne RFP operably linked to a second enhancer (column I), a second promoter (column J), a second intron (column K) and a second polyadenylation signal (column L). Optionally an insulator sequence was interposed between the first polyadenylation signal and the second enhancer (column H). The transposons comprised a sequence whose SEQ ID NO is given in column A between the two ORFs. Transposons were transfected in triplicate independent transfections into CHO cells together with a gene encoding a transposase (SEQ ID NO. 48) fused to a heterologous nuclear localization signal. Cells were selected and expression of the fluorescent proteins measured (columns M and N show the averages of 3 measurements for each fluorescent protein) as described in Example 6.2.1.

Table 8. Integration of Xenopus-derived Transposons for Expression of Two Polypeptides.

Transposons comprised 5'-TTAA-3' target sequences, transposon end sequences SEQ ID NO: 2 and 12, and an enhancer (column F), promoter (column G) and intron (column H) operably linked to a gene encoding DasherGFP. For rows 3-6, vectors further comprised a gene encoding CayenneRFP operably linked to the expression control elements by a translational-coupling sequence (sequences identified in column A). For rows 7-18, vectors further comprised a gene encoding Cayenne RFP operably linked to a second enhancer (column K), a second promoter (column L) and a second intron (column M). Polyadenylation signals were linked to the first (column I) and second (column N) open reading frames. Optionally an insulator sequence was interposed between the first polyadenylation signal and the second enhancer (column J). Transposons comprised a sequence whose SEQ ID NO is given in column A between the two ORFs. Transposons were transfected into CHO cells, optionally (as indicated in column O) together with a gene encoding a transposase (SEQ ID NO: 48) fused to a heterologous nuclear localization signal; cells were selected and expression of the fluorescent proteins measured (columns P-U) as described in Example 6.2.2. Rows 1-2 and 19-20 show the transfection of constructs encoding only GFP (rows 1-2) or RFP (rows 19-20). Rows 21 and 22 shows the co-transfection of the constructs shown in rows 1 and 19. Details are given in Section 6.2.2.

Table 9. Expression from Gene Transfer Systems Comprising Genes Encoding Two Polypeptides Linked by IRES Translational Coupling Elements (5).

Gene transfer polynucleotide s comprised an enhancer), promoter, intron and polyadenylation signal operably linked to a gene encoding DasherGFP, an IRES element and a gene encoding CayenneRFP. IRES element SEQ ID NOs are given in column A). Vectors were transfected into HEK or CHO cells and expression of the fluorescent proteins measured as described in Example 6.4.1. The relative fluorescence of the two proteins is shown in column B (HEK) or F (CHO). The relative expression level of the CayenneRFP to DasherGFP was calculated by correcting for the relative fluorescence levels of the two proteins (CayenneRFP only yields 0.3× the signal of DasherGFP for the same protein level). This is the IRES efficiency shown in column C (HEK) or G (CHO). The expression level of the DasherGFP in the IRES construct was compared with the expression of DasherGFP from a construct lacking an IRES and CayenneRFP and is shown as % GFP shown in column D (HEK) or H (CHO). The number of independent experiments measuring expression of each IRES in each system is shown in column E (HEK) or I (CHO).

Table 10. *Xenopus* Transposons in *Pichia pastoris*

Three transposons (column B) were constructed for modifying the genome of *Pichia pastoris*, and comprised 5'-TTAA-3' target sequences and transposon end SEQ ID Nos: 2 and 12 flanking a heterologous polynucleotide as described in Section 6.5.1. Plasmids in rows 3-8 also comprised a promoter (whose SEQ ID NO is given in column D) operably linked to a gene encoding *Xenopus* transposase SEQ ID NO: 118 on a non-transposable portion of the plasmid. Different amounts (column D) of the three transposons were transformed into competent *Pichia pastoris* cells, grown and plated as described in Section 6.5.1. The number of zeocin resistant colonies on each plate were counted after the cells were grown in non-selective media (900 µl YPD broth plus 1M sorbitol) for 5 (column E) or 24 hours (column F) at 30° C.

Table 11. Substitutions Conferring Hyperactivity on *Xenopus* Transposase.

Transposase variants were created, transposition frequencies were measured and the effect of amino acid substitutions on transposition frequencies were modelled as described in Sections 6.3.1 and 6.3.2. Column A shows the position of substitutions in the *Xenopus* transposase numbering from the beginning of SEQ ID NO: 48, column B shows the identity of that amino acid in SEQ ID NO: 48, column C shows the identity of an amino acid substitution that confers hyperactivity on the transposase, column D shows the mean regression weight of that substitution and column E shows the standard deviation of the regression weight. Column F shows the position of substitutions in the *Bombyx* transposase numbering from the beginning of SEQ ID NO: 407, column G shows the identity of that amino acid in SEQ ID NO: 407, column H shows the identity of an amino acid substitution that confers hyperactivity on the transposase, column I shows the mean regression weight of that substitution and column J shows the standard deviation of the regression weight.

Table 12. Hyperactive *Xenopus* Transposase Active as mRNA in CHO Cells.

Transposons were co-transfected into CHO cells with either plasmid DNA (row 2) or mRNA (rows 3-14) encoding a *Xenopus* transposase (with SEQ ID NO shown in column C) fused to a heterologous nuclear localization signal. Amounts of transposon and transposase nucleic acid transfected into 1 ml of CHO cells are shown in columns E and F. Transfection, growth and selection were as described in Section 6.1.3.3. Expression of Dasher GFP was measured in a plate fluorimeter. Row 15 shows a no DNA control. Columns H and I show fluorescence from duplicate samples 3 days post-transfection but before selection, columns J and K show fluorescence from duplicate samples immediately following a 10-day selection, columns L and M show fluorescence from duplicate samples 5 days post-selection.

Table 13. Hyperactive *Xenopus* and *Bombyx* Transposases Active as mRNA in CHO Cells.

Transposons comprised transposon end sequences with SEQ ID NOs given in columns B and C flanked by target sequences indicated in column D. The transposons further comprised a CMV enhancer and CMV promoter operably linked to a gene encoding DasherGFP, and a gene encoding puromycin acetyl transferase operably linked to a promoter with SEQ ID NO shown in column F. Transposons (750 ng) were co-transfected with 250 ng mRNA encoding a transposase with SEQ ID NO shown in column G, fused to a heterologous nuclear localization signal. Transfection, growth and selection were as described in Section 6.1.3.4. Expression of Dasher GFP was measured in a plate fluorimeter. Row 16 shows a no DNA control. Columns H, I and J show fluorescence from triplicate samples.

Table 14. Relative Transposition Frequencies for Hyperactive Transposases.

Transposase variants were created and transposition frequencies measured in *Saccharomyces cerevisiae* as described in Section 6.3.1 and 6.3.2. Column A shows the SEQ ID NO of hyperactive *Xenopus* transposases, column B shows the transposition frequency of the hyperactive transposase in *Saccharomyces cerevisiae*, relative to the frequency for the naturally occurring sequence SEQ ID NO: 48 under identical conditions. Column C shows the SEQ ID NO of hyperactive *Bombyx* transposases, column D shows the transposition frequency of the hyperactive transposase in *Saccharomyces cerevisiae*, relative to the frequency for the naturally occurring sequence SEQ ID NO: 407 under identical conditions.

Table 15. Hyperactive *Bombyx* Transposases Active in CHO Cells.

Transposons comprised transposon end sequences with SEQ ID NOs given in columns B and C, flanked by target sequences given in column D. The transposons further comprised a promoter (column F) operably linked to a gene encoding DasherGFP, and a gene encoding puromycin acetyl transferase operably linked to a promoter with SEQ ID NO shown in column E. Transposons (750 ng) were co-transfected with 250 ng mRNA (column I) or DNA (column J) encoding a transposase with SEQ ID NO shown in column K, fused to a heterologous nuclear localization signal. Columns L, M and N show the absorbance at 600 nm for triplicate samples. Columns O, P and Q show the DasherGFP fluorescence from the corresponding samples. Experimental details are as given in Section 6.3.2.2.

Table 16. Hyperactive *Xenopus* Transposases Active in CHO Cells.

Transposons comprised insulator sequences with SEQ ID NOs shown in columns D and E, inside transposon end sequences SEQ ID NO: 2 and 12, flanked by 5'-TTAA-3' target sequences. The transposons further comprised a promoter (column C) operably linked to a gene encoding DasherGFP, and a gene encoding puromycin acetyl transferase operably linked to a promoter with SEQ ID NO shown in column B. Transposons (750 ng) were co-transfected with 250 ng DNA encoding a transposase with SEQ ID NO shown in column F, fused to a heterologous nuclear localization signal. Columns G, H and I show the DasherGFP fluorescence from triplicate independent transfections of the corresponding samples. Experimental details are as given in Section 6.3.1.2.

7. REFERENCES

All references cited herein are incorporated herein by reference in their entirety and for all purposes to the same extent as if each individual publication or patent or patent application was specifically and individually indicated to be incorporated by reference in its entirety for all purposes.

Many modifications and variations of this invention can be made without departing from its spirit and scope, as will be apparent to those skilled in the art. The specific embodiments described herein are offered by way of example only, and the invention is to be limited only by the terms of the appended claims, along with the full scope of equivalents to which such claims are entitled.

TABLES 1

|   | A left SEQ* | B right SEQ* | C Int Seq | D system | E dna (ng) | F transposase SEQ* | G nls | H dna (ng) | I Confluence (0-100%) | J GFP1 | K GFP2 | L GFP3 |
|---|---|---|---|---|---|---|---|---|---|---|---|---|
| 3 | 35 | 36 | 5'-TTAA-3' | piggyBac | 500 | none | N/A | 0 | 0 | 5 | 5 | 2 |
| 4 | 35 | 36 | 5'-TTAA-3' | piggyBac | 500 | 698 | no | 160 | 100 | 707 | 677 | 659 |
| 5 | 1 | 11 | 5'-TTAA-3' | Xenopus | 500 | none | N/A | 0 | 0 | 4 | 3 | 3 |
| 6 | 1 | 11 | 5'-TTAA-3' | Xenopus | 500 | 49 | yes | 160 | 100 | 886 | 890 | 779 |
| 7 | 1 | 11 | 5'-TTAA-3' | Xenopus | 500 | 49 | no | 160 | 15 | 104 | 105 | 109 |
| 8 | 1 | 11 | 5'-TTAA-3' | Xenopus | 500 | 48 | yes | 160 | 100 | 828 | 904 | 803 |
| 9 | 1 | 11 | 5'-TTAA-3' | Xenopus | 500 | 48 | no | 160 | 5 | 47 | 45 | 55 |
| 10 | 3 | 12 | 5'-TTAA-3' | Xenopus | 500 | none | N/A | 0 | 0 | 5 | 5 | 6 |
| 11 | 3 | 12 | 5'-TTAA-3' | Xenopus | 500 | 49 | yes | 160 | 100 | 918 | 858 | 820 |
| 12 | 3 | 12 | 5'-TTAA-3' | Xenopus | 500 | 49 | no | 160 | 10 | 27 | 25 | 26 |
| 13 | 3 | 12 | 5'-TTAA-3' | Xenopus | 500 | 48 | yes | 160 | 100 | 953 | 933 | 921 |
| 14 | 3 | 12 | 5'-TTAA-3' | Xenopus | 500 | 48 | no | 160 | 10 | 73 | 76 | 65 |
| 15 | 23 | 29 | 5'-TTAT-3' | Bombyx | 500 | none | N/A | 0 | 0 | 2 | 4 | 4 |
| 16 | 23 | 29 | 5'-TTAT-3' | Bombyx | 500 | 750 | yes | 160 | 0 | 11 | 8 | 8 |
| 17 | 23 | 29 | 5'-TTAT-3' | Bombyx | 500 | 750 | no | 160 | 0 | 2 | 4 | 4 |
| 18 | 23 | 29 | 5'-TTAT-3' | Bombyx | 500 | 407 | yes | 160 | 100 | 1042 | 1089 | 1099 |
| 19 | 23 | 29 | 5'-TTAT-3' | Bombyx | 500 | 407 | no | 160 | 100 | 972 | 1046 | 960 |

*SEQ ID NO.

TABLE 2

|   | A left SEQ* | B right SEQ* | C Int Seq | D transposon | E system | F dna (ng) | G transposase SEQ* | H nls | I dna (ng) | J GFP1 | K GFP2 | L GFP3 |
|---|---|---|---|---|---|---|---|---|---|---|---|---|
| 2 | 23 | 29 | 5'-TTAT-3' | 192465 | Bombyx | 500 | no | N/A | 0 | 6 | 6 | 6 |
| 3 | 23 | 29 | 5'-TTAT-3' | 192465 | Bombyx | 500 | 407 | yes | 160 | 817 | 788 | 705 |
| 4 | 24 | 29 | 5'-TTAT-3' | 214228 | Bombyx | 500 | no | N/A | 0 | 5 | 4 | 4 |
| 5 | 24 | 29 | 5'-TTAT-3' | 214228 | Bombyx | 500 | 407 | yes | 160 | 600 | 591 | 602 |
| 6 | 25 | 29 | 5'-TTAT-3' | 214229 | Bombyx | 500 | no | N/A | 0 | 5 | 5 | 4 |
| 7 | 25 | 29 | 5'-TTAT-3' | 214229 | Bombyx | 500 | 407 | yes | 160 | 103 | 119 | 127 |
| 8 | 23 | 31 | 5'-TTAT-3' | 214230 | Bombyx | 500 | no | N/A | 0 | 5 | 4 | 5 |
| 9 | 23 | 31 | 5'-TTAT-3' | 214230 | Bombyx | 500 | 407 | yes | 160 | 13 | 12 | 11 |
| 10 | 22 | 30 | 5'-TTAA-3' | 214404 | Bombyx | 500 | no | N/A | 0 | 5 | 5 | 5 |
| 11 | 22 | 30 | 5'-TTAA-3' | 214404 | Bombyx | 500 | 407 | yes | 160 | 1035 | 994 | 983 |
| 12 | 22 | 30 | 5'-TTAA-3' | 214404 | Bombyx | 500 | 750 | yes | 160 | 4 | 4 | 3 |
| 13 | 3 | 12 | 5'-TTAA-3' | 192462 | Xenopus | 500 | no | N/A | 0 | 4 | 3 | 4 |
| 14 | 3 | 12 | 5'-TTAA-3' | 192462 | Xenopus | 500 | 48 | yes | 160 | 1048 | 994 | 977 |
| 15 | 4 | 12 | 5'-TTAA-3' | 214231 | Xenopus | 500 | no | N/A | 0 | 4 | 5 | 4 |
| 16 | 4 | 12 | 5'-TTAA-3' | 214231 | Xenopus | 500 | 48 | yes | 160 | 1346 | 1278 | 1269 |
| 17 | 5 | 12 | 5'-TTAA-3' | 217099 | Xenopus | 500 | no | N/A | 0 | 4 | 3 | 3 |
| 18 | 5 | 12 | 5'-TTAA-3' | 217099 | Xenopus | 500 | 48 | yes | 160 | 964 | 872 | 901 |
| 19 | 3 | 13 | 5'-TTAA-3' | 214233 | Xenopus | 500 | no | N/A | 0 | 5 | 4 | 6 |
| 20 | 3 | 13 | 5'-TTAA-3' | 214233 | Xenopus | 500 | 48 | yes | 160 | 1075 | 1014 | 1035 |
| 21 | 8 | 14 | 5'-TTAT-3' | 214406 | Xenopus | 500 | no | N/A | 0 | 4 | 3 | 4 |
| 22 | 8 | 14 | 5'-TTAT-3' | 214406 | Xenopus | 500 | 48 | yes | 160 | 1205 | 1083 | 1058 |
| 23 | 35 | 36 | 5'-TTAA-3' | 136214 | piggyBac | 500 | no | N/A | 0 | 4 | 4 | 5 |
| 24 | 35 | 36 | 5'-TTAA-3' | 136214 | piggyBac | 500 | 698 | no | 160 | 610 | 558 | 577 |
| 25 | 37 | 38 | 5'-TTAT-3' | 214405 | piggyBac | 500 | no | N/A | 0 | 4 | 3 | 4 |
| 26 | 37 | 38 | 5'-TTAT-3' | 214405 | piggyBac | 500 | 698 | no | 160 | 485 | 464 | 451 |
| 27 | N/A | N/A | N/A | none | negative | 0 | no | N/A | 0 | 4 | 5 | 5 |

*SEQ ID NO.

TABLE 3

| 1 | A left SEQ* | B right SEQ* | C Int Seq | D reporter | E transposon | F dna (ng) | G transposase SEQ* | H nls | I dna (ng) | J GFP1 | K GFP2 | L GFP3 |
|---|---|---|---|---|---|---|---|---|---|---|---|---|
| 2 | 1 | 11 | 5'-TTAA-3' | RC3 | 223949 | 500 | no | N/A | 0 | 3 | 4 | 3 |
| 3 | 1 | 11 | 5'-TTAA-3' | RC3 | 223949 | 500 | 48 | yes | 160 | 1157 | 1169 | 1095 |
| 4 | 6 | 11 | 5'-TTAA-3' | RC3 | 223950 | 500 | no | N/A | 0 | 3 | 3 | 4 |
| 5 | 6 | 11 | 5'-TTAA-3' | RC3 | 223950 | 500 | 48 | yes | 160 | 788 | 930 | 887 |
| 6 | 7 | 11 | 5'-TTAA-3' | RC3 | 223953 | 500 | no | N/A | 0 | 3 | 4 | 3 |
| 7 | 7 | 11 | 5'-TTAA-3' | RC3 | 223953 | 500 | 48 | yes | 160 | 965 | 957 | 918 |
| 8 | 1 | 15 | 5'-TTAA-3' | RC3 | 223951 | 500 | no | N/A | 0 | 4 | 4 | 4 |
| 9 | 1 | 15 | 5'-TTAA-3' | RC3 | 223951 | 500 | 48 | yes | 160 | 1118 | 1136 | 1139 |
| 10 | 1 | 16 | 5'-TTAA-3' | RC3 | 223952 | 500 | no | N/A | 0 | 4 | 4 | 3 |
| 11 | 1 | 16 | 5'-TTAA-3' | RC3 | 223952 | 500 | 48 | yes | 160 | 849 | 889 | 863 |
| 12 | 35 | 36 | 5'-TTAA-3' | RC1 | 136214 | 500 | no | N/A | 0 | 3 | 3 | 4 |
| 13 | 35 | 36 | 5'-TTAA-3' | RC1 | 136214 | 500 | 698 | no | 160 | 536 | 555 | 572 |
| 14 | N/A | N/A | N/A | none | none | 0 | no | N/A | 0 | 3 | 3 | 3 |

*SEQ ID NO.

TABLE 4

| Xenopus Transposase | | | | Bombyx Transposase | | | |
|---|---|---|---|---|---|---|---|
| A Position | B WT | C Transposition | D Excision | E Position | F WT | G Transposition | H Excision |
| 2 | A | RHL | GKRPWIMNTEH | 4 | E | T | -n/a- |
| 3 | K | VM | QLGWCA | 9 | R | n/a | P |
| 4 | R | MCPK | AIEM | 12 | A | T | PYQH |
| 5 | F | CNQR | CTHPVYEGN | 13 | M | P | GQN |
| 6 | Y | LHVICGASF | RPDLNHVIC | 14 | L | T | -n/a- |
| 7 | S | GV | DG | 15 | E | G | -n/a- |
| 8 | A | -n/a- | ED | 20 | D | G | HWPQFGKV |
| 9 | E | -n/a- | WD | 21 | Y | -n/a- | K |
| 10 | E | -n/a- | AIVNPDM | 23 | D | -n/a- | HPKS |
| 11 | A | DV | CD | 24 | E | C | YPT |
| 12 | A | -n/a- | YD | 25 | S | TKML | YGKQL |
| 13 | A | P | TPK | 26 | S | R | FMWPYCTKA |
| 14 | H | -n/a- | PTG | 27 | S | N | NCYAGHPLMT |
| 15 | C | GI | AGVDRLYI | 28 | E | -n/a- | AYCNIHPL |
| 16 | M | ENDSQTA | ELHFINDS | 30 | E | -n/a- | HGW |
| 17 | A | SYVLMT | ESYVQL | 32 | D | KQW | INQGWFSYL |
| 18 | S | CYMLQGPAWHK | ICYMVLQG | 33 | H | S | EGDK |
| 19 | S | CVLFKEDGNAMPYRT | CVLFQKEDG | 36 | E | Q | K |
| 20 | S | GMLVHWACQDFN | RGMLVHWACQD | 37 | H | -n/a- | WSDIQG |
| 21 | E | NWGQLDAPTSYV | NWFGQLDM | 39 | V | -n/a- | A |
| 22 | E | CHRLKSGMVQAYW | CHRLKSDGMVQT | 41 | Y | -n/a- | SM |
| 23 | F | QADWKTVMNPHECR | QADYWKTVMNP | 42 | D | -n/a- | V |
| 24 | S | LWHVPIFKYDCNQ | LWHGAVPIFKYDCN | 43 | T | -n/a- | YKIW |
| 25 | G | N | N | 44 | E | CPAQ | ATNQHMDFIVL |
| 26 | S | FHV | FQHYWV | 45 | E | SM | KPCF |
| 27 | D | LV | L | 46 | E | P | APV |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 28 | S | K | YCMLHTQ | 47 | R | -n/a- | KM |
| 29 | E | L | LK | 48 | I | A | -n/a- |
| 31 | V | -n/a- | LTIQK | 49 | D | K | Y |
| 32 | P | -n/a- | SAV | 50 | S | -n/a- | A |
| 33 | P | -n/a- | VHS | 55 | S | -n/a- | A |
| 34 | A | -n/a- | LE | 58 | R | M | -n/a- |
| 35 | S | -n/a- | ELM | 62 | A | K | RWCV |
| 36 | E | -n/a- | SVD | 63 | N | T | ETAW |
| 37 | S | -n/a- | DC | 64 | A | P | HTMV |
| 38 | D | -n/a- | FNA | 65 | I | GQ | -n/a- |
| 39 | S | -n/a- | VT | 66 | 1 | E | PWFT |
| 40 | S | -n/a- | T | 67 | A | -n/a- | DS |
| 41 | T | -n/a- | M | 68 | N | GHQ | SPGVC |
| 42 | E | KN | KNPAS | 69 | E | WQHTMPDLV | QPHTDVC |
| 43 | E | P | QCWKGA | 70 | S | -n/a- | D |
| 44 | S | MEQ | WLM | 71 | D | KLMCNV | KMNLY |
| 45 | W | -n/a- | LCVSPK | 72 | S | FT | ETPDH |
| 46 | C | EQTLHP | MI | 73 | D | -n/a- | AHYECV |
| 47 | S | NC | FAN | 74 | P | -n/a- | VL |
| 48 | S | VA | VKWA | 75 | D | -n/a- | HAW |
| 49 | S | G | YLPVKTMDE | 76 | D | AQGWVSC | SAH |
| 50 | T | DR | ANSK | 77 | D | -n/a- | TY |
| 51 | V | QKYM | TFH | 78 | L | -n/a- | I |
| 52 | S | AT | VAKPF | 79 | P | KG | -n/a- |
| 53 | A | VV | EQYK | 81 | S | -n/a- | Q |
| 54 | L | VPCE | IANV | 83 | V | -n/a- | WQDF |
| 55 | E | HPK | S | 84 | R | NKHYW | ENHYTW |
| 56 | E | V | LPYGQW | 85 | Q | EMKHN | TEKFLH |
| 57 | P | VHTQ | KVSA | 87 | A | MNKHYIC | MNF |
| 58 | M | IVPAKFL | DIRVHN | 88 | S | IY | MV |
| 59 | E | YAH | MDN | 89 | A | -n/a- | KMYC |
| 60 | V | -n/a- | EQ | 90 | S | -n/a- | AD |
| 62 | E | SCWVITLQFKG | -n/a- | 91 | R | -n/a- | A |
| 63 | D | TQP | -n/a- | 92 | Q | EAPNIYHFRDMWCGLV | ADYNRGMFWHTVCPL |
| 64 | V | IMQSKHFLTC | -n/a- | 93 | V | PKMFWL | AIPQWFM |
| 65 | D | MVPLKE | -n/a- | 94 | S | EKTHCL | KEIHYC |
| 66 | D | GEAFW | -n/a- | 95 | G | EAQTKNMHDFLC | ATD |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 67 | L | ATMVCHEY | -n/a- | 96 | P | ATMRGVEQ | EARCV |
| 68 | E | SMYAPNVLQHD | -n/a- | 97 | F | QKHTCWVEPDARG | NADKTHRGYC |
| 69 | D | RAPMLHVSW | -n/a- | 98 | Y | Q | QF |
| 70 | Q | CLTNSGH | -n/a- | 99 | T | N | DA |
| 71 | E | PYMRWLF | -n/a- | 102 | D | -n/a- | W |
| 72 | A | EMTYQIGVFNKLCR | -n/a- | 103 | G | -n/a- | QM |
| 73 | G | HNKFVDSWL | -n/a- | 107 | Y | -n/a- | M |
| 74 | D | T | -n/a- | 108 | K | -n/a- | S |
| 75 | R | WCLMQ | -n/a- | 117 | L | -n/a- | I |
| 76 | A | LREIV | -n/a- | 122 | I | -n/a- | K |
| 77 | D | QYLT | -n/a- | 128 | Q | -n/a- | H |
| 78 | A | QVGRC | -n/a- | 132 | I | -n/a- | HDN |
| 79 | A | FVR | -n/a- | 135 | D | -n/a- | FM |
| 80 | A | LY | -n/a- | 137 | S | -n/a- | HIC |
| 81 | G | STKV | -n/a- | 139 | E | -n/a- | P |
| 82 | G | SLQWE | -n/a- | 140 | Y | -n/a- | WQM |
| 83 | E | FCHRDVN | -n/a- | 145 | I | A | RCAM |
| 84 | P | SFGNVW | -n/a- | 149 | S | EHPQADT | EQCAMKP |
| 85 | A | MCR | -n/a- | 150 | D | PEQ | E |
| 86 | W | G | -n/a- | 152 | L | GR | -n/a- |
| 87 | G | L | -n/a- | 153 | Q | -n/a- | HM |
| 88 | P | AENHDL | -n/a- | 154 | E | Q | DA |
| 89 | P | HM | -n/a- | 157 | T | Q | YCFE |
| 90 | C | KDGNWVQTML | -n/a- | 160 | N | H | -n/a- |
| 91 | N | RALHV | -n/a- | 161 | S | N | KN |
| 92 | F | YRGA | -n/a- | 162 | S | QWE | WCE |
| 93 | P | K | -n/a- | 164 | R | -n/a- | Q |
| 95 | E | QVNL | -n/a- | 165 | H | EGQTMVL | CNDMKLQVWEA |
| 96 | I | TW | -n/a- | 166 | R | CV | CT |
| 97 | P | HV | -n/a- | 167 | Q | -n/a- | K |
| 98 | P | R | -n/a- | 168 | T | YSWCNMGFALV | IYMCWELKG |
| 99 | F | SV | -n/a- | 169 | K | HPSWGCMV | HWYCEMLSV |
| 100 | T | VL | -n/a- | 170 | T | HNG | GQ |
| 101 | T | GFSVL | -n/a- | 171 | A | TG | NYK |
| 103 | P | RV | -n/a- | 172 | A | -n/a- | CQ |
| 104 | G | E | -n/a- | 173 | E | QPA | HQCLM |
| 105 | V | F | -n/a- | 174 | N | -n/a- | R |
| 106 | K | RGME | -n/a- | 175 | S | NKG | KG |

TABLE 4-continued

| | Xenopus Transposase | | | | Bombyx Transposase | | |
|---|---|---|---|---|---|---|---|
| A Position | B WT | C Transposition | D Excision | E Position | F WT | G Transposition | H Excision |
| 107 | V | SR | -n/a- | 176 | S | HT | HKT |
| 108 | D | TH | -n/a- | 177 | A | -n/a- | IYCWMFVG |
| 109 | T | IV | -n/a- | 178 | E | SHYFCAQGV | YCDHLPWQSAVG |
| 111 | N | F | -n/a- | 179 | T | Q | HRK |
| 114 | P | V | -n/a- | 180 | S | -n/a- | YRKV |
| 115 | I | Q | -n/a- | 182 | Y | -n/a- | H |
| 116 | N | DQAF | -n/a- | 183 | M | K | -n/a- |
| 117 | F | L | -n/a- | 184 | Q | H | YPG |
| 118 | F | CSLQ | -n/a- | 185 | E | -n/a- | K |
| 119 | Q | HKS | -n/a- | 186 | T | I | -n/a- |
| 122 | M | V | VC | 187 | T | D | D |
| 123 | T | L | H | 188 | L | I | TG |
| 124 | E | N | SPQ | 189 | C | DYIWTKMFPQ | IKQTV |
| 125 | A | VNITPKLGS | VQD | 194 | L | AMVSTYC | C |
| 126 | I | CVLS | -n/a- | 195 | I | FMV | MV |
| 127 | L | FMC | V | 196 | A | G | G |
| 128 | Q | K | IE | 198 | L | EQWTMI | WT |
| 129 | D | NI | EQL | 200 | L | IFCM | YICMF |
| 130 | M | W | -n/a- | 201 | A | QLM | MQ |
| 132 | L | NFTHEMYQ | KNFTH | 203 | L | VDGECTMA | *YTCMA |
| 133 | Y | T | FH | 204 | I | FACMTGV | DCMNTG |
| 136 | V | MITH | FMDRN | 205 | K | HR | H |
| 137 | Y | HAFNR | HAFQSLN | 206 | S | A | -n/a- |
| 138 | A | G | -n/a- | 207 | N | GA | G |
| 139 | E | S | AITVN | 209 | Q | E | YT |
| 140 | Q | RN | TR | 210 | S | NC | -n/a- |
| 141 | Y | IMQSEWVFACKLHR | IMQSEWVF | 211 | L | GMCTVA | CTV |
| 142 | L | VFANQMIRKGYHW | VFATNQCMIRK | 212 | K | C | -n/a- |
| 143 | T | -n/a- | AYV | 213 | D | E | E |
| 144 | Q | RLMEGFDATV | RNLMHPSECG | 214 | L | IM | IM |
| 145 | N | CMAQIFGDEVHWY | CLRMAQSIFGDEV | 215 | W | Y | Y |
| 146 | P | VTW | CQLYKVNFE | 216 | R | KA | K |
| 147 | L | PQGKVTMFRI | PWQHG | 217 | T | VAIPCQM | IFDQCAKV |
| 148 | P | MRVFT | MRVCFTQH | 219 | G | SAC | CHAQ |
| 149 | R | -n/a- | LQGP | 220 | T | -n/a- | C |
| 150 | Y | WAGFHSVCMNDEQK | WAGFHSV | 222 | V | T | A |
| 151 | A | GS | REGCS | 223 | D | E | NS |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 154 | H | -n/a- | CL | 224 | I | V | V |
| 155 | A | QM | -n/a- | 227 | T | NI | N |
| 157 | H | YFT | SWY | 228 | T | -n/a- | C |
| 158 | P | VE | VGS | 229 | M | F | -n/a- |
| 159 | T | -n/a- | PR | 234 | F | -n/a- | Y |
| 160 | D | -n/a- | YWC | 235 | Q | CNHGWYATEM | AHCEWMTFG |
| 161 | I | AVLQ | AVLYHK | 237 | L | I | IV |
| 162 | A | LVCKT | GMSLIYVCQ | 238 | Q | CMHVL | MTHIL |
| 163 | E | -n/a- | KGD | 239 | N | GSA | G |
| 164 | M | -n/a- | E | 240 | N | CHMA | WSCAMH |
| 165 | K | -n/a- | RTFC | 302 | P | K | -n/a- |
| 166 | R | -n/a- | A | 303 | N | CRG | ADSHERKLQ |
| 167 | F | -n/a- | R | 304 | K | -n/a- | Y |
| 168 | V | LTIM | L | 305 | P | H | -n/a- |
| 169 | G | -n/a- | D | 306 | A | QC | -n/a- |
| 170 | L | -n/a- | D | 307 | K | R | -n/a- |
| 171 | T | A | P | 308 | Y | V | -n/a- |
| 172 | L | I | SAR | 310 | I | WML | L |
| 173 | A | LSG | LMSIG | 311 | K | L | -n/a- |
| 174 | M | ATQ | WASG | 312 | I | FCALTVGM | CAMLV |
| 175 | G | -n/a- | APC | 313 | L | FQIEHCYMV | IHQM |
| 176 | L | -n/a- | DM | 314 | A | DQET | T |
| 177 | I | RVA | RLV | 315 | L | IVM | M |
| 178 | K | -n/a- | RG | 316 | V | IA | TC |
| 179 | A | TKSVR | TK | 317 | D | C | C |
| 180 | N | -n/a- | TSQ | 318 | A | TLECV | CV |
| 181 | S | -n/a- | A | 319 | K | CGNHMALQVSDT | SDICATQV |
| 182 | L | VIQTWR | SVI | 320 | N | ALVRDTQCS | RATGHCMVLK |
| 184 | S | -n/a- | Y | 321 | F | HRNYWDGEMKAQ | NHKMYW |
| 185 | Y | -n/a- | T | 322 | Y | F | FM |
| 187 | D | GI | LMQNGFH | 323 | V | ILTM | MIALT |
| 188 | T | RQSMHIV | RC | 324 | V | NACILTKYHFSQM | GIYHFAMTQLK |
| 189 | T | CNLKQVAWYGFS | CNLKHQVAWYG | 325 | N | -n/a- | HCK |
| 190 | T | C | NW | 326 | L | GCA | AMC |
| 191 | V | -n/a- | AELMQI | 327 | E | NQCHDWFLA | NHMQT |
| 192 | L | VCHM | VICH | 328 | V | TIMP | TAL |
| 193 | S | PTRKGDNFH | PTRKQGYDN | 330 | A | KVP | SPCTLV |
| 194 | I | VP | LHRGCV | 331 | G | -n/a- | A |

TABLE 4-continued

| | Xenopus Transposase | | | | Bombyx Transposase | | |
|---|---|---|---|---|---|---|---|
| A Position | B WT | C Transposition | D Excision | E Position | F WT | G Transposition | H Excision |
| 195 | P | G | SGR | 332 | K | -n/a- | CQ |
| 196 | V | LSWAF | MI | 333 | Q | PTMH | SM |
| 197 | F | -n/a- | SML | 334 | P | H | -n/a- |
| 198 | S | R | AK | 335 | S | HTYKMAGCQLV | NPKYMAECHTQV |
| 199 | A | HGNCKRQWSM | HGNCIKR | 336 | G | PVS | -n/a- |
| 200 | T | CIMLNWVQYH | CRIMLNWV | 337 | P | WEHIAMNDKQ | DGSCKMALV |
| 201 | M | -n/a- | C | 339 | A | G | -n/a- |
| 202 | S | A | PA | 340 | V | G | -n/a- |
| 203 | R | -n/a- | V | 341 | S | NCPA | -n/a- |
| 204 | N | -n/a- | PT | 342 | N | Q | -n/a- |
| 205 | R | -n/a- | L | 343 | R | SKG | -n/a- |
| 206 | Y | -n/a- | P | 344 | P | GNCSA | GSNA |
| 207 | Q | -n/a- | T | 345 | F | STAQGC | PAKMC |
| 208 | L | Q | PG | 346 | E | IQN | -n/a- |
| 209 | L | IM | IMA | 347 | V | L | -n/a- |
| 210 | L | H | A | 349 | E | TD | TG |
| 211 | R | TCQASK | TCQASK | 352 | I | V | -n/a- |
| 212 | F | YNM | CAYN | 353 | Q | NET | -n/a- |
| 213 | L | -n/a- | PM | 355 | V | F | -n/a- |
| 214 | H | -n/a- | NYMQASE | 356 | A | R | -n/a- |
| 215 | F | WE | Q | 357 | R | W | -n/a- |
| 216 | N | -n/a- | Q | 359 | H | -n/a- | GC |
| 217 | N | E | Q | 361 | N | TCQM | VCM |
| 218 | N | VRTC | VRGIPDE | 362 | V | -n/a- | L |
| 219 | A | WGEV | DTLQWIMY | 365 | D | YKT | T |
| 220 | T | EI | ADEL | 367 | W | YF | -n/a- |
| 221 | A | M | VC | 368 | F | -n/a- | Y |
| 222 | V | TILK | QPTILSK | 369 | T | SA | -n/a- |
| 223 | P | -n/a- | TS | 370 | G | HQ | -n/a- |
| 224 | P | QDS | QMDVR*EK | 371 | Y | -n/a- | P |
| 225 | D | KYL | KEPGRMAN | 372 | E | -n/a- | PT |
| 226 | Q | R | AP | 373 | L | VIST | TI |
| 227 | P | VDASTNF | VHGDAES | 374 | M | G | -n/a- |
| 228 | G | -n/a- | HTRQ | 375 | L | C | -n/a- |
| 229 | H | LP | VD | 376 | H | YAK | Q |
| 230 | D | -n/a- | Q | 379 | N | GA | -n/a- |
| 231 | R | P | -n/a- | 380 | E | WC | T |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 233 | H | PV | FPW | 381 | Y | -n/a- | HL |
| 234 | K | -n/a- | ALCDVE | 382 | R | NK | K |
| 235 | L | IV | IV | 385 | S | -n/a- | -n/a- |
| 236 | R | -n/a- | Q | 386 | V | TICL | TLIC |
| 237 | P | Q | -n/a- | 387 | G | -n/a- | S |
| 238 | L | -n/a- | VDN | 388 | T | -n/a- | V |
| 239 | I | V | L | 389 | V | IMTL | MAL |
| 240 | D | N | HVR | 391 | K | -n/a- | IMTPL |
| 242 | L | IAE*FRS | NWIAE | 392 | N | RFV | HFVQ |
| 243 | S | GTLQ | GT | 394 | R | HKT | PMTA |
| 244 | E | RNHLMQ | RFVDNHLM | 395 | Q | PFECVA | HSYPA |
| 245 | R | QITECP | QKNI | 398 | E | -n/a- | QA |
| 246 | F | SRL | SR | 399 | S | NEKHDYGQRTAV | KMQG |
| 247 | A | RECSQHV | RECGSNQ | 400 | F | GCPWLYM | YWM |
| 248 | A | SLHCNIQY | SLMHCDN | 401 | I | VCKT | WK |
| 249 | V | TPIAY | TPMID | 402 | R | YKDFGNEMSQTCLV | SEQFK |
| 250 | Y | PHT | PHT | 403 | T | WAVFLYNGCISMQK | NFGICEQVL |
| 251 | T | ISKVLMQD | ISNYKVR | 404 | D | ISENHCMGAQLPV | WMESFANLGVQP |
| 252 | P | L | L | 405 | R | NTL | G |
| 253 | C | RTLHNGDQVM | RTLHNGDQ | 406 | Q | FG | ICE |
| 254 | Q | MVL | RH | 407 | P | KTIQMV | K |
| 255 | N | -n/a- | A | 408 | N | FIAEMSDYHCQVWL | IAPEKLHV |
| 256 | I | VC | V | 409 | S | HYNIDFTC | QDNT |
| 257 | C | WR | V | 410 | S | THY | TC |
| 258 | I | DRH | DRH | 411 | V | EQHDS | -n/a- |
| 259 | D | TR | TR | 412 | F | AW | -n/a- |
| 260 | E | V | V | 414 | F | W | -n/a- |
| 261 | S | A | A | 415 | Q | N | AN |
| 262 | L | SA | SA | 416 | K | -n/a- | S |
| 263 | L | VAMRD | VAM | 418 | I | C | -n/a- |
| 264 | L | VPDKMR | VS | 419 | T | FICS | -n/a- |
| 265 | F | YK | EHYW | 420 | L | M | -n/a- |
| 266 | K | GRA | GR | 424 | A | -n/a- | D |
| 267 | G | PL | P | 426 | K | -n/a- | T |
| 268 | R | A | ACHYQK | 428 | N | S | H |
| 269 | L | SIVCQ | SIVC | 430 | V | -n/a- | D |
| 270 | Q | VKACPLIEGYNTW | VHKACPL | 432 | V | Y | THMC |
| 271 | F | VPT | VP | 433 | V | -n/a- | L |

TABLE 4-continued

| \multicolumn{4}{|c|}{Xenopus Transposase} | \multicolumn{4}{|c|}{Bombyx Transposase} |
|---|---|---|---|---|---|---|---|
| A Position | B WT | C Transposition | D Excision | E Position | F WT | G Transposition | H Excision |
| 272 | R | KILSVC | K | 434 | M | Q | A |
| 273 | Q | MVE | MVITN | 436 | T | -n/a- | S |
| 274 | Y | HI | H | 440 | D | SCMLV | SIKCAQ |
| 275 | I | PLM | PL | 441 | N | FRMGCDL | GFAVLW |
| 276 | P | IRAWCL | IR | 442 | S | YKFVL | KGFCYWV |
| 277 | S | EAK | EA | 443 | I | EFV | AYK |
| 278 | K | AL | A | 444 | D | QIMV | MA |
| 279 | R | YQKVGS | Y | 445 | E | PYHCGKMQL | CGMKPNLTW |
| 280 | A | S | S | 446 | S | -n/a- | EAMDYCPLWG |
| 281 | R | LY | LYK | 447 | T | -n/a- | QS |
| 282 | Y | LQGCVHSNT | LQGCEVH | 448 | G | WYHCTV | NWQ |
| 283 | G | YI | YAI | 449 | E | APTL | HGTCIL |
| 284 | I | QVGLF | QV | 450 | K | -n/a- | T |
| 285 | K | I | I | 451 | Q | VENDSRYHGFCITPMWL | ENTRCSMYAW |
| 286 | F | LT | L | 452 | K | IFVL | -n/a- |
| 287 | Y | QKSFW | QKSF | 454 | E | -n/a- | C |
| 288 | K | TADFLC | T | 455 | M | QCLV | PGCVI |
| 289 | L | CTRGYVE | CTR | 456 | I | ACMLTV | V |
| 290 | C | TVQ | T | 457 | T | CGA | A |
| 291 | E | VD | VCND | 458 | F | ADC | A |
| 292 | S | RVA | R | 461 | S | KGEDYA | KTL |
| 293 | S | NDHTWAK | NDHTWAK | 464 | A | S | T |
| 294 | S | RNGT | RCNGT | 466 | V | TC | C |
| 295 | G | TDSL | TDS | 468 | V | QMT | CT |
| 296 | Y | HE | HE | 469 | V | TAHCL | HACT |
| 297 | T | CPVMLD | CPVML | 471 | E | Q | -n/a- |
| 298 | S | EVMKGLNCQA | EVMKGLNCQA | 472 | L | KQM | -n/a- |
| 299 | Y | HKCREGAN | HKCREGA | 473 | C | GSQT | IGSTM |
| 300 | F | YM | VCIYM | 474 | A | CQMGT | CTV |
| 301 | L | -n/a- | -n/a- | 475 | N | -n/a- | S |
| 302 | I | -n/a- | V | 477 | N | -n/a- | D |
| 304 | E | H | DHSQC | 483 | K | R | N |
| 305 | G | -n/a- | E | 484 | R | -n/a- | HK |
| 306 | K | -n/a- | NL | 485 | W | FYTDKEQMV | -n/a- |
| 307 | D | -n/a- | F | 486 | P | -n/a- | EMA |
| 308 | S | -n/a- | RG | 488 | T | KV | V |
| 309 | K | -n/a- | GCHMLQE | 489 | L | YIV | CTV |

TABLE 4-continued

| | Xenopus Transposase | | | | Bombyx Transposase | | |
|---|---|---|---|---|---|---|---|
| A Position | B WT | C Transposition | D Excision | E Position | F WT | G Transposition | H Excision |
| 310 | L | R | IRV | 491 | Y | V | -n/a- |
| 311 | D | -n/a- | FHYWSNRILC | 492 | G | A | A |
| 312 | P | -n/a- | C | 493 | V | HQWMIL | IML |
| 313 | P | SMLY | VSFKMHE | 496 | M | D | L |
| 314 | G | ASIHL | NQM | 499 | I | DHWTCEMALV | CWV |
| 315 | C | -n/a- | SR | 502 | C | SYML | -n/a- |
| 316 | P | N | RDA | 503 | I | MALQF | QFL |
| 317 | P | DLK | DNFMHCGVALKE | 505 | Y | -n/a- | Q |
| 318 | D | RL | NTAFKQHRCWEM | 507 | T | RDSGKIMECAL | DIMECAVL |
| 319 | L | CVF | CIDVAM | 509 | K | H | -n/a- |
| 320 | T | CGSNKHMV | CGSRNKQ | 510 | N | KGA | QGK |
| 321 | V | I | INT | 511 | V | KA | CTEKA |
| 322 | S | -n/a- | ICT | 512 | T | MA | MCA |
| 323 | G | -n/a- | A | 513 | I | V | M |
| 324 | K | G | SR | 514 | K | -n/a- | P |
| 325 | I | -n/a- | L | 515 | R | K | -n/a- |
| 326 | V | -n/a- | WT | 516 | T | -n/a- | S |
| 327 | W | -n/a- | M | 517 | E | DA | NKAQ |
| 328 | E | SHKVWFQLT | SYIHRKVWADFMCQ | 521 | S | HKQGE | HCGETK |
| 329 | L | -n/a- | GM | 523 | G | QTAMSC | TMSICLA |
| 330 | I | AV | M | 524 | L | KM | HIYM |
| 331 | S | AGQP | AKWNDRG | 525 | S | Q | CNDTQ |
| 332 | P | Q | KGD | 527 | I | MV | M |
| 333 | L | M | WFM | 528 | Y | NWMQKV | IGDNAQMER |
| 334 | L | V | VMC | 529 | D | E | -n/a- |
| 335 | G | K | LCNEA | 531 | L | -n/a- | M |
| 336 | Q | YNMATL | YNIGFEMVCH | 532 | H | M | CV |
| 338 | F | SHP | SYH | 533 | S | IMELVA | WMIQEVA |
| 339 | H | -n/a- | QR | 535 | N | GVL | SCMFVL |
| 340 | L | V | V | 536 | K | A | -n/a- |
| 342 | V | -n/a- | GC | 537 | K | M | -n/a- |
| 343 | D | AN | -n/a- | 539 | N | HGC | -n/a- |
| 344 | N | MGS | RQTMG | 540 | I | FM | M |
| 345 | F | G | YW | 542 | T | CAR | HRK |
| 346 | Y | S | S | 543 | Y | CWI | MQACRH |
| 347 | S | V | T | 545 | R | -n/a- | H |
| 348 | S | -n/a- | T | 546 | Q | F | C |
| 349 | I | -n/a- | V | 549 | E | KCIQA | HCMQSFLA |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 351 | L | H | R | 550 | K | RMQ | -n/a- |
| 352 | F | C | -n/a- | 551 | Q | A | -n/a- |
| 353 | T | -n/a- | SCV | 552 | L | -n/a- | I |
| 354 | A | VWD | VCRWEKHG | 553 | G | TA | HP |
| 355 | L | T | -n/a- | 554 | E | D | YCL |
| 356 | Y | C | H | 555 | P | ED | YDC |
| 357 | C | QHWNIVMRF | DQHWNIV | 556 | S | GV | I |
| 358 | L | AFERQVHCMY | AFKERQNIVH | 557 | P | WTSAQK | DKGNLV |
| 359 | D | ALHRSQE | ALHMR | 558 | R | K | SMQ |
| 360 | T | P | PLYSP | 559 | H | KSC | SIWK |
| 361 | P | -n/a- | QS | 560 | V | FPI | HYKIP |
| 362 | A | -n/a- | P | 561 | N | P | QGA |
| 363 | C | -n/a- | W | 562 | V | Y | ISM |
| 364 | G | -n/a- | D | 563 | P | ITKE | DE |
| 366 | I | -n/a- | L | 564 | G | L | QPCF |
| 367 | N | -n/a- | TGR | 565 | R | K | -n/a- |
| 368 | R | -n/a- | TAWKP | 566 | Y | M | -n/a- |
| 369 | D | -n/a- | RVAQSLML | 567 | V | IH | N |
| 371 | K | -n/a- | A | 570 | Q | F | N |
| 372 | G | -n/a- | FY | 571 | D | SFVQM | NSMTAV |
| 373 | L | -n/a- | MI | 573 | P | K | MT |
| 375 | R | -n/a- | SQKAVPT | 574 | Y | V | A |
| 376 | A | -n/a- | TCLVEIMGK | 575 | K | -n/a- | H |
| 377 | L | -n/a- | VI | 576 | K | W | I |
| 378 | L | -n/a- | ITMCKYV | 581 | K | H | -n/a- |
| 379 | D | -n/a- | A | 583 | S | M | -n/a- |
| 380 | K | -n/a- | LAFTVE | 585 | N | -n/a- | SKGL |
| 381 | K | -n/a- | LPVRITN | 586 | A | E | NH |
| 382 | L | -n/a- | VC | 588 | A | GRF | -n/a- |
| 383 | N | -n/a- | LIDFPVESGAHK | 593 | M | -n/a- | I |
| 384 | R | -n/a- | C | 594 | E | C | -n/a- |
| 385 | G | -n/a- | NWAMCHYSKQ | 597 | K | -n/a- | W |
| 387 | T | -n/a- | RE | 598 | F | M | -n/a- |
| 388 | Y | -n/a- | FV | 599 | L | Y | -n/a- |
| 389 | A | -n/a- | YF | 601 | E | V | FQW |
| 390 | L | -n/a- | V | 602 | N | GRQHTEDS | GTQMEH |
| 392 | K | -n/a- | YMWC | 603 | C | D | -n/a- |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 393 | N | -n/a- | EA | 604 | A | I | DTSI |
| 394 | E | -n/a- | F | 605 | E | RWKMPYCHAQSV | PYAMRWHQVIGK |
| 397 | A | -n/a- | SIFLCVM | 606 | L | VQYAEGCKNHM | EQCYANWMVK |
| 399 | K | -n/a- | ASH | 607 | D | VYCNWTAHQELKG | HQTYWCANLEKG |
| 400 | F | -n/a- | C | 608 | S | EDRM | QWRCV |
| 401 | F | -n/a- | YD | 609 | S | RWHVQGTKN | WHTGNYKV |
| 402 | D | -n/a- | G | 610 | L | TIKGAWDQSFN | DSI |
| 405 | N | -n/a- | VD | | | | |
| 406 | L | -n/a- | GTM | | | | |
| 409 | L | -n/a- | I | | | | |
| 422 | R | G | QLKWSM | | | | |
| 423 | V | NPTFHCS | GARLNPTFHC | | | | |
| 424 | G | CNSL | CKQYPWNTHS | | | | |
| 425 | E | -n/a- | SAQCAPGH | | | | |
| 426 | P | LKYF | TWLVCSQHKYN | | | | |
| 428 | K | RQ | NTFR | | | | |
| 429 | N | GPYM | GWPYEHRAMS | | | | |
| 430 | K | R | QPR | | | | |
| 431 | P | LQ | LTC | | | | |
| 432 | L | TMF | HTSQMN | | | | |
| 434 | S | A | AT | | | | |
| 435 | K | LTR | YMHISVLA | | | | |
| 436 | E | QAMLY | WHCQAFML | | | | |
| 438 | S | QA | QMA | | | | |
| 439 | K | LMR | HALMCR | | | | |
| 440 | Y | FLT | WQFLH | | | | |
| 442 | G | -n/a- | W | | | | |
| 443 | G | V | V | | | | |
| 444 | V | -n/a- | C | | | | |
| 446 | R | LMK | HTLMK | | | | |
| 447 | T | SAC | QSNAGC | | | | |
| 450 | L | MVA | MIVE | | | | |
| 451 | Q | LMF | ALMF | | | | |
| 452 | H | -n/a- | AS | | | | |
| 455 | N | D | E | | | | |
| 457 | T | -n/a- | C | | | | |
| 458 | R | -n/a- | * | | | | |
| 460 | T | S | A | | | | |

TABLE 4-continued

| | Xenopus Transposase | | | | Bombyx Transposase | | |
|---|---|---|---|---|---|---|---|
| A Position | B WT | C Transposition | D Excision | E Position | F WT | G Transposition | H Excision |
| 461 | R | YQKT | Y | | | | |
| 462 | A | MTYFKRQHE | MTYNFCKRQH | | | | |
| 464 | Y | -n/a- | QW | | | | |
| 465 | K | VHM | VHT | | | | |
| 467 | V | TCA | KTC | | | | |
| 468 | G | SF | CST | | | | |
| 469 | I | V | NV | | | | |
| 470 | Y | H | -n/a- | | | | |
| 471 | L | VM | FCVM | | | | |
| 472 | I | VLW | VMLFW | | | | |
| 473 | Q | -n/a- | D | | | | |
| 474 | M | AT | IQAT | | | | |
| 475 | A | STG | -n/a- | | | | |
| 476 | L | M | IVNFMCQ | | | | |
| 477 | R | AQ | HV | | | | |
| 478 | N | -n/a- | K | | | | |
| 479 | S | L | L | | | | |
| 480 | Y | HF | H | | | | |
| 482 | V | L | L | | | | |
| 483 | Y | T | T | | | | |
| 484 | K | G | GEAFVS | | | | |
| 485 | A | CQV | C | | | | |
| 486 | A | EHCV | R | | | | |
| 487 | V | NTR | NCMW | | | | |
| 488 | P | EHKQFM | ELND | | | | |
| 489 | G | -n/a- | YFQ | | | | |
| 490 | P | GTHAKL | GTCIMH | | | | |
| 491 | K | QVGCLM | QVIGW | | | | |
| 492 | L | -n/a- | VQ | | | | |
| 493 | S | ATP! | GA | | | | |
| 494 | Y | F | M | | | | |
| 495 | Y | FL | MF | | | | |
| 496 | K | H | VQ | | | | |
| 497 | Y | T | -n/a- | | | | |
| 498 | Q | CM | VLGHTCEM | | | | |
| 499 | L | HACVQTRNW | HGACVQKTR | | | | |
| 500 | Q | ECRHA | ETCRFMVH | | | | |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 501 | I | LMVS | TLM | | | | |
| 502 | L | IMVG | FIMV | | | | |
| 503 | P | HENCASLQ | HENCV | | | | |
| 504 | A | NMVIPWDQLTKGFHYS | NMVIPWDQLTK | | | | |
| 505 | L | MC | M | | | | |
| 506 | L | MIC | HQMI | | | | |
| 507 | F | VWHMK | IV | | | | |
| 508 | G | QTYR | IS | | | | |
| 509 | G | NLRMKQHIPCFA | TNWLRMKQ | | | | |
| 510 | V | MCAN | HKM | | | | |
| 511 | E | TMILP | TYQMF | | | | |
| 512 | E | SYMKVARLTI | SGP | | | | |
| 513 | Q | YFVNISKW | YFVPMAE | | | | |
| 514 | T | QVHFMRP | QWNVHFMGR | | | | |
| 515 | V | FTRAL | KFHS | | | | |
| 516 | P | -n/a- | LM | | | | |
| 517 | E | MVAKL | MGVASI | | | | |
| 518 | M | SHLFTA | IRSHLWFVG | | | | |
| 519 | P | WR | FWMND | | | | |
| 520 | P | WRMFQVGDKY | WERMLTFQVGDK | | | | |
| 521 | S | AHCVW | TKFAHG | | | | |
| 522 | D | AR | VNEAFH | | | | |
| 523 | N | WAGSPM | WQALKGDHSFC | | | | |
| 524 | V | PMA | PH | | | | |
| 525 | A | QLIR | QMLNI | | | | |
| 527 | L | VHMRANFW | SYVHTCMRAIQ | | | | |
| 528 | I | LKVFQHNTG | RLKVFAMQHY | | | | |
| 529 | G | -n/a- | MAHDLVWC | | | | |
| 530 | K | QG | MVQR | | | | |
| 531 | H | RP | -n/a- | | | | |
| 532 | F | CMVQ | CIHYRNMKVTA | | | | |
| 533 | I | VF | MVTSFGE | | | | |
| 534 | D | EQLRVCMNAGF | THEQLKRVCMNSA | | | | |
| 535 | T | SRALV | SRCAFLGVHKINMW | | | | |
| 536 | L | Q | DMIQHSRKEVF | | | | |
| 537 | P | -n/a- | NF | | | | |
| 538 | P | -n/a- | TAFGVYKW | | | | |
| 539 | T | SNL | SMKQI | | | | |

TABLE 4-continued

| Xenopus Transposase | | | | Bombyx Transposase | | | |
|---|---|---|---|---|---|---|---|
| A Position | B WT | C Transposition | D Excision | E Position | F WT | G Transposition | H Excision |
| 540 | P | KH | KEVRMFN | | | | |
| 541 | G | -n/a- | K | | | | |
| 542 | K | -n/a- | QNYHT | | | | |
| 543 | Q | -n/a- | T | | | | |
| 544 | R | -n/a- | FD | | | | |
| 545 | P | -n/a- | T | | | | |
| 546 | Q | T | TAVYN | | | | |
| 547 | K | -n/a- | T | | | | |
| 548 | G | -n/a- | DE | | | | |
| 549 | C | -n/a- | AY | | | | |
| 550 | K | N | NPCSFLT | | | | |
| 551 | V | -n/a- | AYM | | | | |
| 552 | C | -n/a- | H | | | | |
| 553 | R | K | NMTVHK | | | | |
| 554 | K | VT | VMACLGYFIPE | | | | |
| 555 | R | HV | ELKHVGDIFMTN | | | | |
| 556 | G | SCN | VMFDSKCQA | | | | |
| 557 | I | KFSV | RNHQLKPFCG | | | | |
| 558 | R | G | GL | | | | |
| 559 | R | H | HIVLTGKEYSWMFQN | | | | |
| 560 | D | G | TRLHSVMAGNC | | | | |
| 561 | T | V | SVAQI | | | | |
| 562 | R | -n/a- | VK | | | | |
| 563 | Y | -n/a- | AFNSGR | | | | |
| 564 | Y | TV | GMFTNQ | | | | |
| 565 | C | -n/a- | V | | | | |
| 566 | P | VHKQ | VHGASMK | | | | |
| 567 | K | ML | MLQVT | | | | |
| 568 | C | -n/a- | W | | | | |
| 569 | P | YT | VLYSEMTF | | | | |
| 570 | R | F | VLMTYK | | | | |
| 571 | N | VDMK | FVWTDMYK | | | | |
| 572 | P | -n/a- | VNQF | | | | |
| 573 | G | -n/a- | RCA | | | | |
| 574 | L | M | TMIP | | | | |
| 575 | C | H | H | | | | |
| 576 | F | LKVDWMCR | LKQAVYDWNMGCIER | | | | |

TABLE 4-continued

| | Xenopus Transposase | | | | Bombyx Transposase | | | |
|---|---|---|---|---|---|---|---|---|
| A Position | B WT | C Transposition | D Excision | | E Position | F WT | G Transposition | H Excision |
| 577 | K | LGDRHYI | EVLGDRNHYI | | | | | |
| 578 | P | SENTQVM | SCKENGID | | | | | |
| 579 | C | -n/a- | Y | | | | | |
| 580 | F | M | EAH | | | | | |
| 581 | E | IWRSGVHAC | ILWRFQSGDTVM | | | | | |
| 582 | I | VKRMG | NEVKAQ | | | | | |
| 583 | Y | L | CFDQ | | | | | |
| 584 | H | -n/a- | L | | | | | |
| 585 | T | G | QHANCY | | | | | |
| 586 | Q | LCRYHFENKGAW | LVTDMCRYHFENKGA | | | | | |
| 587 | L | FDRIPNESYMQGWKT | FDRIPNESYMQGWKT | | | | | |
| 588 | H | RK | SMWRGE | | | | | |
| 589 | Y | VCKMIEDQR | SVCFHKNWGPMI | | | | | |

TABLE 5

| | A left SEQ* | B right SEQ* | C transposon | D DNA (ng) | E transposase SEQ* | F nls | G transposase promoter | H DNA (ng) | I RNA (ng) | J GFP1 | K GFP2 | L GFP3 |
|---|---|---|---|---|---|---|---|---|---|---|---|---|
| 1 | | | | | | | | | | | | |
| 2 | 35 | 36 | 136214 | 500 | no | N/A | N/A | 0 | 0 | 4 | 5 | 6 |
| 3 | 35 | 36 | 136214 | 500 | 698 | no | N/A | 160 | 0 | 468 | 458 | 476 |
| 4 | 1 | 11 | 202970 | 500 | no | N/A | N/A | 0 | 0 | 6 | 6 | 5 |
| 5 | 1 | 11 | 202970 | 500 | 48 | yes | CMV | 160 | 0 | 1079 | 1086 | 1137 |
| 6 | 1 | 11 | 202970 | 500 | 48 | yes | PGK | 160 | 0 | 248 | 269 | 244 |
| 7 | 1 | 11 | 202970 | 500 | 48 | yes | UBB | 160 | 0 | 179 | 188 | 196 |
| 8 | 1 | 11 | 202970 | 500 | 48 | yes | SV40 | 160 | 0 | 1305 | 1247 | 1293 |
| 9 | 1 | 11 | 202970 | 500 | 48 | yes | N/A | 0 | 125 | 74 | 78 | 78 |
| 10 | 1 | 11 | 202970 | 500 | 48 | yes | N/A | 0 | 250 | 262 | 252 | 249 |
| 11 | 1 | 11 | 202970 | 500 | 48 | yes | N/A | 0 | 500 | 328 | 347 | 342 |
| 12 | 1 | 11 | 202970 | 500 | 48 | yes | N/A | 0 | 1000 | 45 | 40 | 45 |
| 13 | 3 | 12 | 192462 | 500 | no | N/A | N/A | 0 | 0 | 5 | 6 | 6 |
| 14 | 3 | 12 | 192462 | 500 | 48 | yes | CMV | 160 | 0 | 820 | 873 | 915 |
| 15 | 3 | 12 | 192462 | 500 | 48 | yes | PGK | 160 | 0 | 44 | 42 | 40 |
| 16 | 3 | 12 | 192462 | 500 | 48 | yes | UBB | 160 | 0 | 29 | 31 | 31 |
| 17 | 3 | 12 | 192462 | 500 | 48 | yes | SV40 | 160 | 0 | 1535 | 1523 | 1537 |
| 18 | 3 | 12 | 192462 | 500 | 48 | yes | N/A | 0 | 125 | 13 | 14 | 15 |
| 19 | 3 | 12 | 192462 | 500 | 48 | yes | N/A | 0 | 250 | 97 | 113 | 115 |
| 20 | 3 | 12 | 192462 | 500 | 48 | yes | N/A | 0 | 500 | 283 | 271 | 277 |
| 21 | 3 | 12 | 192462 | 500 | 48 | yes | N/A | 0 | 1000 | 31 | 31 | 30 |
| | N/A | N/A | N/A | 0 | no | N/A | N/A | 0 | 0 | 2 | 5 | 4 |

*SEQ ID NO.

TABLE 6

| | A left SEQ* | B reporter SEQ* | C right SEQ* | D transposon | E DNA (ng) | F transposase SEQ* | G nls | H DNA (ng) | I RNA (ng) | J GFP1 | K GFP2 | L GFP3 |
|---|---|---|---|---|---|---|---|---|---|---|---|---|
| 1 | | | | | | | | | | | | |
| 2 | 35 | 39 | 36 | 136214 | 500 | no | N/A | 0 | 0 | 7 | 7 | 9 |
| 3 | 35 | 39 | 36 | 136214 | 500 | 698 | no | 160 | 0 | 57 | 59 | 60 |
| 4 | 23 | 39 | 29 | 192465 | 500 | 407 | yes | 0 | 0 | 6 | 6 | 5 |
| 5 | 23 | 39 | 29 | 192465 | 500 | 407 | yes | 0 | 125 | 37 | 35 | 35 |
| 6 | 23 | 39 | 29 | 192465 | 500 | 407 | yes | 0 | 250 | 786 | 783 | 792 |
| 7 | 23 | 39 | 29 | 192465 | 500 | 407 | yes | 0 | 500 | 903 | 908 | 934 |
| 8 | 23 | 39 | 29 | 192465 | 500 | 407 | yes | 0 | 1000 | 184 | 198 | 225 |
| 9 | 23 | 39 | 29 | 192465 | 500 | 407 | yes | 125 | 0 | 311 | 322 | 336 |
| 10 | 23 | 39 | 29 | 192465 | 500 | 407 | yes | 250 | 0 | 254 | 260 | 272 |

TABLE 6-continued

| 1 | A left SEQ* | B reporter SEQ* | C right SEQ* | D transposon | E DNA (ng) | F transposase SEQ* | G nls | H DNA (ng) | I RNA (ng) | J GFP1 | K GFP2 | L GFP3 |
|---|---|---|---|---|---|---|---|---|---|---|---|---|
| 11 | 23 | 39 | 29 | 192465 | 500 | 407 | yes | 500 | 0 | 174 | 176 | 193 |
| 12 | 23 | 40 | 29 | 194093 | 500 | no | N/A | 0 | 0 | 884 | 911 | 936 |
| 13 | 23 | 40 | 29 | 194093 | 500 | 407 | yes | 0 | 125 | 2861 | 2533 | 2830 |
| 14 | 23 | 40 | 29 | 194093 | 500 | 407 | yes | 0 | 250 | 4123 | 3907 | 4074 |
| 15 | 23 | 40 | 29 | 194093 | 500 | 407 | yes | 0 | 500 | 5668 | 5564 | 5554 |
| 16 | 23 | 40 | 29 | 194093 | 500 | 407 | yes | 0 | 1000 | 7387 | 7062 | 7355 |
| 17 | 23 | 40 | 29 | 194093 | 500 | 407 | yes | 125 | 0 | 7863 | 7281 | 7000 |
| 18 | 23 | 40 | 29 | 194093 | 500 | 407 | yes | 250 | 0 | 7684 | 8043 | 8335 |
| 19 | 23 | 40 | 29 | 194093 | 500 | 407 | yes | 500 | 0 | 8201 | 7826 | 7684 |
| 20 | N/A | N/A | N/A | N/A | 0 | no | N/A | 0 | 0 | 4 | 4 | 4 |

*SEQ ID NO.

TABLE 7

| Row | A Linker SEQ* | B Gene | C GFP | D RFP | E Promoter 1 | F Intron 1 | G polyA1 | H intergenic insulator | I Enhancer 2 | J Promoter 2 | K Intron 2 | L pA2 | M GFP | N RFP | O R/G | P ORF2/ORF1 | Q D % |
|---|---|---|---|---|---|---|---|---|---|---|---|---|---|---|---|---|---|
| 1 | N/A | 188550 | no | yes | EF1a | EF1a | globin (rabbit) | N/A | N/A | N/A | N/A | N/A | 4 | 1564 | N/A | N/A | 0.00 |
| 2 | N/A | 181650 | yes | no | EF1a | EF1a | globin (rabbit) | N/A | N/A | N/A | N/A | N/A | 8542 | 2 | N/A | N/A | 1.00 |
| 3 | N/A | 146674 | yes | yes | EF1a | EF1a | N/A | N/A | N/A | N/A | N/A | globin (rabbit) | 1508 | 322 | 0.21 | 1.00 | 0.18 |
| 4 | 1051 | 188209 | yes | yes | EF1a | EF1a | N/A | N/A | N/A | N/A | N/A | globin (rabbit) | 9964 | 741 | 0.07 | 0.33 | 1.17 |
| 5 | 1062 | 206694 | yes | yes | EF1a | EF1a | N/A | N/A | N/A | N/A | N/A | globin (rabbit) | 6248 | 604 | 0.10 | 0.48 | 0.73 |
| 6 | 1063 | 206695 | yes | yes | EF1a | EF1a | N/A | N/A | N/A | N/A | N/A | globin (rabbit) | 6206 | 529 | 0.09 | 0.43 | 0.73 |
| 7 | 1064 | 206696 | yes | yes | EF1a | EF1a | N/A | N/A | N/A | N/A | N/A | globin (rabbit) | 6280 | 586 | 0.09 | 0.43 | 0.74 |
| 8 | 1011 | 203906 | yes | yes | EF1a | EF1a | HSV-TK/gastrin | no | CMV | EF1a | no | globin (rabbit) | 1830 | 117 | 0.06 | 0.29 | 0.21 |
| 9 | 1023 | 203907 | yes | yes | EF1a | EF1a | HSV-TK/gastrin | no | CMV | actin | no | globin (rabbit) | 1982 | 97 | 0.05 | 0.24 | 0.23 |
| 10 | 1025 | 203909 | yes | yes | EF1a | EF1a | HSV-TK/gastrin | no | no | EF1a | no | globin (rabbit) | 2714 | 80 | 0.03 | 0.14 | 0.32 |
| 11 | 998 | 203910 | yes | yes | EF1a | EF1a | HSV-TK/gastrin | no | CMV | CMV | CMVc | globin (rabbit) | 1613 | 565 | 0.35 | 1.67 | 0.19 |
| 12 | 1002 | 203914 | yes | yes | EF1a | EF1a | HSV-TK/gastrin | 2xHS4c | CMV | GAPDH | GAPDH | globin (rabbit) | 2432 | 688 | 0.28 | 1.33 | 0.29 |
| 13 | 1000 | 203912 | yes | yes | EF1a | EF1a | HSV-TK/gastrin | no | CMV | GAPDH | eMLP | globin (rabbit) | 2150 | 316 | 0.15 | 0.71 | 0.25 |
| 14 | 1001 | 203913 | yes | yes | EF1a | EF1a | HSV-TK/gastrin | 2xHS4c | no | EF1a | EF1a | globin (rabbit) | 2853 | 1504 | 0.53 | 2.52 | 0.33 |
| 15 | 1024 | 203908 | yes | yes | EF1a | EF1a | HSV-TK/gastrin | no | no | EF1a | EF1a | globin (rabbit) | 2795 | 252 | 0.09 | 0.43 | 0.33 |
| 16 | 1003 | 203915 | yes | yes | EF1a | EF1a | HSV-TK/gastrin | 2xHS4c | CMV | CMV | no | globin (rabbit) | 2505 | 142 | 0.06 | 0.29 | 0.29 |
| 17 | 999 | 203911 | yes | yes | EF1a | EF1a | HSV-TK/gastrin | no | CMV | CMV | no | globin (rabbit) | 1012 | 118 | 0.12 | 0.57 | 0.12 |
| 18 | 1004 | 203916 | yes | yes | EF1a | EF1a | HSV-TK/gastrin | 2xHS4c | no | EF1a | eMLP | globin (rabbit) | 3430 | 537 | 0.16 | 0.76 | 0.40 |
| 19 | 1005 | 203917 | yes | yes | EF1a | EF1a | HSV-TK/gastrin | no | no | EF1a | eMLP | globin (rabbit) | 2390 | 185 | 0.08 | 0.38 | 0.28 |
| 20 | 1006 | 203918 | yes | yes | EF1a | EF1a | HSV-TK/gastrin | 2xHS4c | CMV | GAPDH | CMVc | globin (rabbit) | 1903 | 533 | 0.28 | 1.33 | 0.22 |
| 21 | 1007 | 203919 | yes | yes | EF1a | EF1a | HSV-TK/gastrin | no | CMV | GAPDH | CMVc | globin (rabbit) | 2169 | 310 | 0.14 | 0.67 | 0.25 |
| 22 | 1008 | 203920 | yes | yes | EF1a | EF1a | HSV-TK/gastrin | 2xHS4c | CMV | GAPDH | no | globin (rabbit) | 2046 | 410 | 0.20 | 0.95 | 0.24 |
| 23 | 1009 | 207390 | yes | yes | EF1a | EF1a | HSV-TK/gastrin | no | CMV | GAPDH | no | globin (rabbit) | 2087 | 226 | 0.11 | 0.52 | 0.24 |

*SEQ ID NO.

TABLE 8

| Row | A Linker SEQ* | B Trans-poson 1 | C Trans-poson 2 | D GFP | E RFP | F Enhancer 1 (Transposon) | G Promoter 1 (Transposon) | H Intron 1 (Transposon) | I polyA1 (Transposon) | J intergenic insulator (Transposon) | K Enhancer 2 (Transposon) | L Promoter 2 (Transposon) |
|---|---|---|---|---|---|---|---|---|---|---|---|---|
| 1 | N/A | 187151 | N/A | yes | no | CMV | CMV | none | globin (rabbit) | N/A | N/A | N/A |
| 2 | N/A | 187151 | N/A | yes | no | CMV | CMV | none | globin (rabbit) | N/A | N/A | N/A |
| 3 | 1051 | 188209 | N/A | yes | yes | none | EF1a | EF1a | N/A | N/A | none | none |
| 4 | 1051 | 188209 | N/A | yes | yes | none | EF1a | EF1a | N/A | N/A | none | none |
| 5 | 1054 | 188219 | N/A | yes | yes | none | EF1a | EF1a | N/A | N/A | none | none |
| 6 | 1054 | 188219 | N/A | yes | yes | none | EF1a | EF1a | N/A | N/A | none | none |
| 7 | 998 | 198833 | N/A | yes | yes | CMV | CMV | none | HSV-TK | none | CMV | CMV |
| 8 | 998 | 198833 | N/A | yes | yes | CMV | CMV | none | HSV-TK | none | CMV | CMV |
| 9 | 999 | 198834 | N/A | yes | yes | CMV | CMV | none | HSV-TK | none | CMV | CMV |
| 10 | 999 | 198834 | N/A | yes | yes | CMV | CMV | none | HSV-TK | none | CMV | CMV |
| 11 | 1000 | 198835 | N/A | yes | yes | CMV | CMV | none | HSV-TK | none | CMV | GAPDH |
| 12 | 1000 | 198835 | N/A | yes | yes | CMV | CMV | none | HSV-TK | none | CMV | GAPDH |
| 13 | 1001 | 198836 | N/A | yes | yes | CMV | CMV | none | HSV-TK | 2x HS4 core | none | EF1a |
| 14 | 1001 | 198836 | N/A | yes | yes | CMV | CMV | none | HSV-TK | 2x HS4 core | none | EF1a |
| 15 | 1002 | 198837 | N/A | yes | yes | CMV | CMV | none | HSV-TK | 2x HS4 core | CMV | GAPDH |
| 16 | 1002 | 198837 | N/A | yes | yes | CMV | CMV | none | HSV-TK | 2x HS4 core | CMV | GAPDH |
| 17 | 1003 | 198838 | N/A | yes | yes | CMV | CMV | none | HSV-TK | 2x HS4 core | CMV | CMV |
| 18 | 1003 | 198838 | N/A | yes | yes | CMV | CMV | none | HSV-TK | 2x HS4 core | CMV | CMV |
| 19 | N/A | 200967 | N/A | no | yes | CMV | CMV | none | globin (rabbit) | N/A | N/A | N/A |
| 20 | N/A | 200967 | N/A | no | yes | CMV | CMV | none | globin (rabbit) | N/A | N/A | N/A |
| 21 | N/A | 187151 | 200967 | yes | yes | CMV | CMV | none | globin (rabbit) | N/A | N/A | N/A |
| 22 | N/A | 187151 | 200967 | yes | yes | CMV | CMV | none | globin (rabbit) | N/A | N/A | N/A |

| Row | M Intron 2 (Transposon) | N pA2 (Transposon) | O Transposase | P GFP Expression 1 | Q GFP Expression 2 | R GFP Expression 3 | S RFP Expression 1 | T RFP Expression 2 | U RFP Expression 3 |
|---|---|---|---|---|---|---|---|---|---|
| 1 | N/A | N/A | no | 70 | 66 | 65 | 2 | 2 | 2 |
| 2 | N/A | N/A | yes | 1250 | 1083 | 1330 | 1 | 2 | 1 |
| 3 | none | globin (rabbit) | no | 706 | 660 | 698 | 62 | 60 | 66 |
| 4 | none | globin (rabbit) | yes | 6764 | 4922 | 5238 | 643 | 467 | 480 |
| 5 | none | globin (rabbit) | no | 307 | 370 | 375 | 32 | 38 | 36 |
| 6 | none | globin (rabbit) | yes | 3656 | 4019 | 4243 | 407 | 452 | 474 |
| 7 | CMVc | globin (rabbit) | no | 20 | 17 | 17 | 15 | 12 | 17 |
| 8 | CMVc | globin (rabbit) | yes | 87 | 94 | 99 | 113 | 120 | 126 |
| 9 | none | globin (rabbit) | no | 19 | 22 | 21 | 9 | 10 | 10 |
| 10 | none | globin (rabbit) | yes | 152 | 128 | 141 | 64 | 56 | 62 |
| 11 | eMLP | globin (rabbit) | no | 26 | 32 | 27 | 17 | 17 | 18 |
| 12 | eMLP | globin (rabbit) | yes | 272 | 231 | 222 | 306 | 257 | 237 |
| 13 | EF1a | globin (rabbit) | no | 38 | 39 | 36 | 104 | 94 | 98 |
| 14 | EF1a | globin (rabbit) | yes | 320 | 374 | 449 | 1102 | 1245 | 1471 |
| 15 | GAPDH | globin (rabbit) | no | 67 | 55 | 55 | 58 | 45 | 42 |
| 16 | GAPDH | globin (rabbit) | yes | 396 | 470 | 411 | 418 | 483 | 425 |
| 17 | none | globin (rabbit) | no | 25 | 27 | 22 | 11 | 13 | 10 |
| 18 | none | globin (rabbit) | yes | 280 | 260 | 245 | 122 | 118 | 104 |
| 19 | N/A | N/A | no | 5 | 5 | 4 | 4 | 10 | 11 |
| 20 | N/A | N/A | yes | 5 | 6 | 6 | 375 | 389 | 392 |
| 21 | N/A | N/A | no | 34 | 33 | 35 | 7 | 8 | 8 |
| 22 | N/A | N/A | yes | 546 | 583 | 628 | 186 | 196 | 197 |

*SEQ ID NO.

TABLE 9

| Row | A IRES SEQ* | B HEK RFP/GFP | C HEK IRES efficiency | D HEK GFP % | E HEK # measurements | F CHO RFP/GFP | G CHO IRES efficiency | H CHO GFP % | I CHO # measurements |
|---|---|---|---|---|---|---|---|---|---|
| 1 | 1050 | 0.07 | 0.22 | 0.39 | 3 | 0.08 | 0.28 | 0.15 | 4 |
| 2 | 1051 | 0.12 | 0.41 | 0.44 | 4 | 0.11 | 0.38 | 0.29 | 4 |
| 3 | 1052 | 0.10 | 0.35 | 0.25 | 4 | 0.04 | 0.13 | 0.47 | 5 |
| 4 | 1053 | 0.05 | 0.17 | 0.39 | 3 | 0.05 | 0.17 | 0.25 | 4 |

TABLE 9-continued

| Row | A IRES SEQ* | B HEK RFP/ GFP | C HEK IRES efficiency | D HEK GFP % | E HEK # measurements | F CHO RFP/ GFP | G CHO IRES efficiency | H CHO GFP % | I CHO # measurements |
|---|---|---|---|---|---|---|---|---|---|
| 5  | 1065 | 0.08 | 0.27 | 0.26 | 2 | 0.09 | 0.30 | 0.14 | 2 |
| 6  | 1066 | 0.07 | 0.23 | 0.51 | 4 | 0.02 | 0.08 | 0.62 | 4 |
| 7  | 1067 | 0.00 | 0.01 | 0.31 | 2 | 0.01 | 0.05 | 0.21 | 2 |
| 8  | 1068 | 0.08 | 0.25 | 0.48 | 3 | 0.02 | 0.06 | 0.58 | 4 |
| 9  | 1069 | 0.03 | 0.08 | 0.21 | 1 | 0.01 | 0.02 | 0.39 | 1 |
| 10 | 1070 | 0.01 | 0.04 | 0.15 | 1 | 0.00 | 0.01 | 0.26 | 1 |
| 11 | 1071 | 0.13 | 0.45 | 0.46 | 3 | 0.09 | 0.28 | 0.54 | 3 |
| 12 | 1072 | 0.07 | 0.23 | 0.16 | 2 | 0.02 | 0.08 | 0.58 | 3 |
| 13 | 1073 | 0.06 | 0.19 | 0.58 | 2 | 0.07 | 0.24 | 0.25 | 3 |
| 14 | 1074 | 0.03 | 0.10 | 0.54 | 1 | 0.04 | 0.14 | 0.38 | 2 |
| 15 | 1075 | 0.12 | 0.39 | 0.37 | 2 | 0.05 | 0.15 | 0.72 | 3 |
| 16 | 1076 | 0.11 | 0.35 | 0.32 | 1 | 0.04 | 0.15 | 0.79 | 2 |
| 17 | 1077 | 0.03 | 0.11 | 0.33 | 1 | 0.01 | 0.05 | 0.66 | 2 |
| 18 | 1078 | 0.03 | 0.10 | 0.32 | 1 | 0.02 | 0.06 | 0.85 | 1 |
| 19 | 1079 | 0.07 | 0.22 | 0.61 | 2 | 0.03 | 0.12 | 0.64 | 1 |
| 20 | 1080 | 0.07 | 0.22 | 0.51 | 2 | 0.04 | 0.12 | 0.84 | 1 |
| 21 | 1081 | 0.11 | 0.35 | 0.32 | 1 | 0.04 | 0.12 | 0.67 | 1 |
| 22 | 1082 | 0.06 | 0.22 | 0.56 | 2 | 0.08 | 0.25 | 0.35 | 2 |
| 23 | 1083 | 0.08 | 0.27 | 0.40 | 2 | 0.10 | 0.33 | 0.25 | 2 |
| 24 | 1084 | 0.05 | 0.16 | 0.66 | 1 | 0.06 | 0.21 | 0.47 | 1 |
| 25 | 1085 | 0.04 | 0.13 | 0.57 | 1 | 0.04 | 0.14 | 0.30 | 1 |
| 26 | 1086 | 0.11 | 0.35 | 0.30 | 2 | 0.05 | 0.15 | 0.82 | 3 |
| 27 | 1087 | 0.08 | 0.27 | 0.42 | 2 | 0.09 | 0.28 | 0.16 | 2 |
| 28 | 1088 | 0.11 | 0.36 | 0.41 | 2 | 0.04 | 0.15 | 0.66 | 3 |
| 29 | 1089 | 0.02 | 0.06 | 0.38 | 1 | 0.02 | 0.05 | 0.85 | 1 |
| 30 | 1090 | 0.02 | 0.07 | 0.33 | 1 | 0.01 | 0.03 | 0.41 | 1 |
| 31 | 1091 | 0.00 | 0.01 | 0.21 | 1 | 0.00 | 0.01 | 0.63 | 1 |
| 32 | 1092 | 0.02 | 0.07 | 0.26 | 1 | 0.03 | 0.11 | 0.35 | 1 |
| 33 | 1093 | 0.07 | 0.23 | 0.25 | 3 | 0.03 | 0.10 | 0.58 | 4 |
| 34 | 1094 | 0.00 | 0.01 | 0.17 | 2 | 0.01 | 0.04 | 0.60 | 3 |
| 35 | 1096 | 0.06 | 0.18 | 0.29 | 1 | nd | nd | nd | 0 |

*SEQ ID NO.

TABLE 10

| 1 | A Construct | B plasmid configuration | C Transposase promoter SEQ* | D DNA (ug) | E outgrowth 5 hours | F 24 hours |
|---|---|---|---|---|---|---|
| 2  | N/A    | N/A      | N/A  | 0   | 0   | 0     |
| 3  | 251587 | circular | 949  | 0.2 | 0   | 48    |
| 4  | 251587 | circular | 949  | 1   | 11  | 93    |
| 5  | 251587 | circular | 949  | 2   | 26  | 276   |
| 6  | 251588 | circular | 954  | 0.2 | 13  | 58    |
| 7  | 251588 | circular | 954  | 1   | 60  | 221   |
| 8  | 251588 | circular | 954  | 2   | 137 | 456   |
| 9  | 251589 | circular | none | 0.2 | 2   | 0     |
| 10 | 251589 | circular | none | 1   | 0   | 1     |
| 11 | 251589 | circular | none | 2   | 1   | 6     |
| 12 | 251589 | linear   | none | 1   | 661 | ~1000 |

*SEQ ID NO.

TABLE 11

| A Xenopus Position | B From | C To | D Weight | E Weight Std | F Bombyx Position | G From | H To | I Weight | J Weight Std |
|---|---|---|---|---|---|---|---|---|---|
| 6  | Y | C | 0.09  | 0.03 | 85  | Q | E | -0.01 | 0.03 |
| 7  | S | G | 0.25  | 0.05 | 92  | Q | A | 0.09  | 0.03 |
| 9  | E | D | 0.00  | 0.01 | 92  | Q | L | -0.06 | 0.08 |
| 16 | M | S | 0.23  | 0.05 | 92  | Q | N | -0.04 | 0.02 |
| 18 | S | G | -0.03 | 0.05 | 93  | V | L | 0.35  | 0.08 |
| 19 | S | G | 0.05  | 0.02 | 93  | V | M | 0.20  | 0.09 |
| 20 | S | D | 0.20  | 0.02 | 96  | P | G | 0.07  | 0.02 |
| 20 | S | G | 0.26  | 0.03 | 97  | F | C | 0.03  | 0.03 |
| 20 | S | Q | 0.40  | 0.05 | 97  | F | H | 0.18  | 0.03 |
| 21 | E | D | 0.38  | 0.07 | 165 | H | E | 0.28  | 0.07 |
| 22 | E | Q | 0.17  | 0.05 | 165 | H | W | 0.27  | 0.07 |
| 23 | F | P | 0.25  | 0.07 | 178 | E | H | 0.13  | 0.06 |
| 23 | F | T | 0.37  | 0.10 | 178 | E | S | 0.29  | 0.04 |
| 24 | S | Y | 0.17  | 0.05 | 189 | C | P | 0.12  | 0.08 |
| 26 | S | V | 0.10  | 0.05 | 196 | A | G | 0.48  | 0.02 |
| 28 | S | Q | 0.10  | 0.03 | 200 | L | F | -0.10 | 0.08 |
| 31 | V | K | 0.04  | 0.02 | 200 | L | I | 0.46  | 0.05 |

TABLE 11-continued

| A Xenopus Position | B From | C To | D Weight | E Weight Std | F Bombyx Position | G From | H To | I Weight | J Weight Std |
|---|---|---|---|---|---|---|---|---|---|
| 34 | A | E | 0.03 | 0.02 | 200 | L | M | 0.01 | 0.02 |
| 67 | L | A | 0.10 | 0.04 | 201 | A | Q | 0.22 | 0.10 |
| 73 | G | H | 0.29 | 0.06 | 203 | L | T | −0.03 | 0.11 |
| 76 | A | V | 0.15 | 0.04 | 207 | N | G | −0.01 | 0.07 |
| 77 | D | N | 0.11 | 0.02 | 211 | L | A | 0.20 | 0.03 |
| 88 | P | A | 0.05 | 0.02 | 215 | W | Y | 0.19 | 0.03 |
| 91 | N | D | 0.14 | 0.06 | 217 | T | A | −0.05 | 0.02 |
| 141 | Y | A | 0.14 | 0.03 | 217 | T | K | 0.00 | 0.08 |
| 141 | Y | Q | 0.33 | 0.04 | 219 | G | A | −0.04 | 0.04 |
| 145 | N | E | 0.03 | 0.02 | 219 | G | S | 0.02 | 0.03 |
| 145 | N | V | 0.02 | 0.03 | 235 | Q | G | 0.13 | 0.08 |
| 146 | P | K | 0.10 | 0.03 | 235 | Q | N | −0.06 | 0.09 |
| 146 | P | T | 0.11 | 0.04 | 235 | Q | Y | 0.33 | 0.08 |
| 146 | P | V | 0.11 | 0.03 | 238 | Q | L | 0.51 | 0.08 |
| 148 | P | H | 0.03 | 0.02 | 242 | R | Q | −0.06 | 0.06 |
| 148 | P | T | 0.42 | 0.04 | 246 | K | I | 0.24 | 0.05 |
| 150 | Y | C | 0.10 | 0.05 | 253 | K | V | 0.32 | 0.10 |
| 150 | Y | G | 0.25 | 0.05 | 258 | M | V | 0.18 | 0.06 |
| 150 | Y | S | 0.21 | 0.04 | 261 | F | L | 0.15 | 0.05 |
| 157 | H | Y | 0.37 | 0.06 | 263 | S | K | 0.28 | 0.07 |
| 162 | A | C | 0.18 | 0.06 | 271 | C | S | 0.36 | 0.04 |
| 179 | A | K | 0.36 | 0.04 | 303 | N | R | 0.11 | 0.07 |
| 182 | L | I | 0.27 | 0.06 | 312 | I | V | −0.02 | 0.08 |
| 182 | L | V | 0.16 | 0.08 | 321 | F | D | 0.12 | 0.06 |
| 189 | T | G | 0.04 | 0.03 | 321 | F | W | 0.18 | 0.08 |
| 192 | L | H | 0.01 | 0.02 | 323 | V | T | 0.01 | 0.02 |
| 193 | S | K | 0.03 | 0.05 | 324 | V | H | 0.28 | 0.07 |
| 193 | S | N | 0.03 | 0.03 | 324 | V | K | 0.32 | 0.08 |
| 196 | V | I | 0.03 | 0.02 | 330 | A | V | 0.34 | 0.09 |
| 198 | S | G | 0.26 | 0.04 | 333 | Q | M | 0.00 | 0.04 |
| 200 | T | W | 0.02 | 0.02 | 337 | P | A | −0.02 | 0.03 |
| 202 | S | A | −0.01 | 0.06 | 368 | F | Y | −0.08 | 0.10 |
| 210 | L | H | 0.15 | 0.05 | 373 | L | C | 0.25 | 0.06 |
| 212 | F | N | 0.17 | 0.09 | 373 | L | V | 0.10 | 0.04 |
| 218 | N | E | 0.11 | 0.06 | 389 | V | L | 0.15 | 0.05 |
| 248 | A | N | 0.50 | 0.05 | 394 | R | T | −0.01 | 0.11 |
| 263 | L | M | 0.35 | 0.06 | 395 | Q | P | −0.11 | 0.10 |
| 270 | Q | L | 0.07 | 0.03 | 399 | S | N | 0.07 | 0.02 |
| 294 | S | T | 0.23 | 0.06 | 402 | R | K | 0.11 | 0.06 |
| 297 | T | M | 0.18 | 0.07 | 403 | T | L | 0.09 | 0.04 |
| 304 | E | Q | −0.02 | 0.03 | 404 | D | I | −0.02 | 0.01 |
| 308 | S | R | 0.05 | 0.03 | 404 | D | M | 0.10 | 0.07 |
| 310 | L | R | 0.26 | 0.07 | 404 | D | Q | 0.35 | 0.07 |
| 333 | L | M | 0.14 | 0.09 | 404 | D | S | 0.27 | 0.07 |
| 336 | Q | M | 0.02 | 0.05 | 408 | N | H | −0.03 | 0.03 |
| 354 | A | H | 0.12 | 0.03 | 409 | S | N | −0.07 | 0.08 |
| 357 | C | V | 0.31 | 0.06 | 441 | N | R | 0.02 | 0.08 |
| 358 | L | F | 0.08 | 0.04 | 448 | G | W | 0.09 | 0.05 |
| 359 | D | N | 0.28 | 0.09 | 449 | E | A | 0.04 | 0.05 |
| 377 | L | I | 0.10 | 0.08 | 469 | V | T | 0.02 | 0.03 |
| 423 | V | H | 0.25 | 0.06 | 472 | L | M | −0.06 | 0.07 |
| 426 | P | K | 0.21 | 0.07 | 473 | C | Q | 0.30 | 0.04 |
| 428 | K | R | 0.04 | 0.04 | 484 | R | K | 0.15 | 0.10 |
| 434 | S | A | −0.06 | 0.09 | 507 | T | C | 0.17 | 0.03 |
| 438 | S | A | 0.08 | 0.05 | 523 | G | A | 0.10 | 0.03 |
| 447 | T | A | 0.20 | 0.05 | 527 | I | M | 0.05 | 0.11 |
| 447 | T | C | −0.01 | 0.04 | 528 | Y | K | 0.80 | 0.08 |
| 447 | T | G | 0.34 | 0.07 | 543 | Y | I | 0.20 | 0.06 |
| 450 | L | V | 0.8 | 0.05 | 549 | E | A | 0.18 | 0.02 |
| 462 | A | H | 0.67 | 0.03 | 550 | K | M | 0.28 | 0.07 |
| 462 | A | Q | 0.37 | 0.04 | 556 | S | V | −0.04 | 0.07 |
| 467 | V | C | −0.04 | 0.04 | 557 | P | S | 0.22 | 0.06 |
| 469 | I | V | 0.21 | 0.05 | 559 | H | K | −0.04 | 0.06 |
| 472 | I | L | 0.01 | 0.06 | 560 | V | F | −0.01 | 0.02 |
| 476 | L | M | −0.02 | 0.05 | 561 | N | P | −0.04 | 0.05 |
| 488 | P | E | 0.00 | 0.05 | 562 | V | Y | −0.08 | 0.05 |
| 498 | Q | M | 0.17 | 0.09 | 567 | V | H | 0.00 | 0.05 |
| 502 | L | V | 0.31 | 0.07 | 567 | V | I | 0.02 | 0.05 |
| 517 | E | I | 0.05 | 0.02 | 583 | S | M | −0.02 | 0.05 |
| 520 | P | D | 0.35 | 0.05 | 601 | E | V | 0.31 | 0.06 |
| 520 | P | G | 0.09 | 0.07 | 605 | E | C | −0.11 | 0.09 |
| 520 | P | K | 0.00 | 0.03 | 605 | E | H | 0.28 | 0.05 |
| 521 | S | G | 0.00 | 0.05 | 605 | E | M | −0.06 | 0.06 |
| 523 | N | S | 0.34 | 0.05 | 605 | E | W | 0.05 | 0.05 |
| 533 | I | E | 0.02 | 0.07 | 607 | D | C | −0.05 | 0.02 |
| 534 | D | A | 0.17 | 0.04 | 607 | D | H | 0.04 | 0.03 |

TABLE 11-continued

| A Xenopus Position | B From | C To | D Weight | E Weight Std | F Bombyx Position | G From | H To | I Weight | J Weight Std |
|---|---|---|---|---|---|---|---|---|---|
| 576 | F | E | 0.12 | 0.05 | 607 | D | K | −0.02 | 0.01 |
| 576 | F | R | 0.42 | 0.06 | 607 | D | N | −0.02 | 0.04 |
| 577 | K | I | 0.26 | 0.03 | 609 | S | H | 0.25 | 0.03 |
| 582 | I | R | 0.01 | 0.07 | 609 | S | V | −0.02 | 0.01 |
| 583 | Y | F | 0.06 | 0.07 | 610 | L | I | 0.19 | 0.03 |
| 587 | L | W | 0.03 | 0.07 | | | | | |
| 587 | L | Y | 0.35 | 0.06 | | | | | |

TABLE 12

| 1 | A RNA | B DNA | C Transposase SEQ* | D Transposon | E Transposon | F Transposase | G DNA:RNA Ratio | H Transient | I Transient | J Selection | K Selection | L Recovery | M Recovery |
|---|---|---|---|---|---|---|---|---|---|---|---|---|---|
| 2 | no | yes | 48 | CMV no insulators | N/A | none | N/A | 1150 | 629 | 172 | 157 | 233 | 143 |
| 3 | yes | no | 48 | CMV no insulators | 750 ng | 250 ng | 3:1 | 735 | 976 | 351 | 916 | 4211 | 4229 |
| 4 | yes | no | 48 | CMV no insulators | 660 ng | 330 ng | 2:1 | 516 | 509 | 228 | 184 | 1505 | 822 |
| 5 | yes | no | 48 | CMV no insulators | 500 ng | 500 ng | 1:1 | 436 | 351 | 146 | 139 | 134 | 118 |
| 6 | yes | no | 168 | CMV no insulators | 750 ng | 250 ng | 3:1 | 1006 | 476 | 1342 | 2053 | 4229 | 6040 |
| 7 | yes | no | 168 | CMV no insulators | 660 ng | 330 ng | 2:1 | 842 | 770 | 1918 | 4350 | 5936 | 5709 |
| 8 | yes | no | 168 | CMV no insulators | 500 ng | 500 ng | 1:1 | 548 | 542 | 2263 | 1284 | 5162 | 4927 |
| 9 | yes | no | 189 | CMV no insulators | 750 ng | 250 ng | 3:1 | 1107 | 420 | 2073 | 1072 | 5883 | 5323 |
| 10 | yes | no | 189 | CMV no insulators | 660 ng | 330 ng | 2:1 | 837 | 654 | 1119 | 1796 | 5126 | 6111 |
| 11 | yes | no | 189 | CMV no insulators | 500 ng | 500 ng | 1:1 | 664 | 680 | 3935 | 2853 | 6218 | 4647 |
| 12 | yes | no | 175 | CMV no insulators | 750 ng | 250 ng | 3:1 | 872 | 468 | 3442 | 3012 | 5676 | 7511 |
| 13 | yes | no | 175 | CMV no insulators | 660 ng | 330 ng | 2:1 | 928 | 605 | 2479 | 2233 | 5616 | 5173 |
| 14 | yes | no | 175 | CMV no insulators | 500 ng | 500 ng | 1:1 | 644 | 508 | 3832 | 1840 | 5276 | 5344 |
| 15 | no | no | none | none | 0 | 0 | N/A | 236 | 280 | 143 | 140 | 143 | 122 |

*SEQ ID NO.

TABLE 13

| 1 | A transposon | B left SEQ* | C right SEQ* | D Int Seq | E system | F puro promoter SEQ* | G transposase SEQ* | H GFP1 | I GFP2 | J GFP3 |
|---|---|---|---|---|---|---|---|---|---|---|
| 2 | 187151 | 2 | 12 | 5'-TTAA-3' | Xenopus | 937 | 175 | 875 | 63 | 979 |
| 3 | 187151 | 2 | 12 | 5'-TTAA-3' | Xenopus | 937 | 189 | 909 | 957 | 135 |
| 4 | 187151 | 2 | 12 | 5'-TTAA-3' | Xenopus | 937 | none | 236 | 84 | 84 |
| 5 | 241555 | 1095 | 11 | 5'-TTAA-3' | Xenopus | 942 | 189 | 2594 | 91 | 3168 |
| 6 | 241555 | 1095 | 11 | 5'-TTAA-3' | Xenopus | 942 | 175 | 2934 | 3746 | 4365 |
| 7 | 241555 | 1095 | 11 | 5'-TTAA-3' | Xenopus | 942 | none | 94 | 93 | 102 |
| 8 | 246143 | 2 | 12 | 5'-TTAA-3' | Xenopus | 942 | 175 | 2445 | 2361 | 2324 |
| 9 | 246143 | 2 | 12 | 5'-TTAA-3' | Xenopus | 942 | none | 66 | 68 | 63 |
| 10 | 194094 | 23 | 29 | 5'-TTAT-3' | Bombyx | 937 | 407 | 426 | 710 | 630 |
| 11 | 194094 | 23 | 29 | 5'-TTAT-3' | Bombyx | 937 | 1098 | 708 | 89 | 741 |
| 12 | 194094 | 23 | 29 | 5'-TTAT-3' | Bombyx | 937 | none | 88 | 92 | 94 |
| 13 | 240671 | 22 | 30 | 5'-TTAA-3' | Bombyx | 937 | 407 | 641 | 89 | 89 |
| 14 | 240671 | 22 | 30 | 5'-TTAA-3' | Bombyx | 937 | 1098 | 664 | 808 | 681 |
| 15 | 240671 | 22 | 30 | 5'-TTAA-3' | Bombyx | 937 | none | 379 | 94 | 94 |
| 16 | none | N/A | N/A | N/A | none | N/A | N/A | 87 | 91 | 87 |

*SEQ ID NO.

TABLE 14

| A Xenopus SEQ* | B hyperactivity | C Bombyx SEQ* | D hyperactivity |
|---|---|---|---|
| 228 | 9 | 654 | 1.3 |
| 244 | 7 | 639 | 1.9 |
| 247 | 6 | 634 | 2.0 |
| 252 | 6 | 619 | 3 |
| 268 | 5 | 614 | 3 |
| 51 | 0.4 | 1097 | 4 |
| 64 | 80 | 596 | 4 |
| 56 | 126 | 595 | 4 |
| 57 | 122 | 588 | 5 |
| 124 | 25 | 557 | 7 |

TABLE 14-continued

| A<br>Xenopus<br>SEQ* | B<br>hyperactivity | C<br>Bombyx<br>SEQ* | D<br>hyperactivity |
|---|---|---|---|
| 52 | 414 | 518 | 11 |
| 58 | 116 | 517 | 11 |
| 54 | 127 | 508 | 12 |
| 73 | 58 | 491 | 15 |
| 71 | 64 | 488 | 15 |
| 65 | 79 | 457 | 31 |
| 63 | 91 | 449 | 35 |
| 62 | 95 | 417 | 94 |
| 61 | 99 | 416 | 97 |
| 59 | 112 | 415 | 107 |
| 168 | 15 | 414 | 122 |
| 189 | 13 | 413 | 130 |
| 175 | 15 | 412 | 164 |
| 118 | 22 | | |
| 211 | 10 | | |
| 216 | 9 | | |

*SEQ ID NO.

TABLE 16

| | A<br>trans-<br>poson | B<br>puro<br>pro-<br>moter<br>SEQ* | C<br>GFP<br>pro-<br>moter | D<br>L<br>insu-<br>lator<br>SEQ* | E<br>R<br>insu-<br>lator<br>SEQ* | F<br>Uribo<br>Trans-<br>posase<br>SEQ* | G<br>GFP | H<br>GFP | I<br>GFP |
|---|---|---|---|---|---|---|---|---|---|
| 1 | 246143 | 942 | CMV | none | none | 48 | 94 | 94 | 112 |
| 2 | 246143 | 942 | CMV | none | none | 58 | 99 | 2600 | 111 |
| 3 | 246143 | 942 | CMV | none | none | none | 107 | 94 | 98 |
| 4 | 246170 | 942 | EF1a | 864 | 860 | 48 | 95 | 93 | 108 |
| 5 | 246170 | 942 | EF1a | 864 | 860 | 61 | 4075 | 113 | 94 |
| 6 | 246170 | 942 | EF1a | 864 | 860 | none | 114 | 95 | 100 |
| 7 | 261961 | 948 | EF1a | 864 | 864 | 48 | 96 | 97 | 112 |
| 8 | 261961 | 948 | EF1a | 864 | 864 | 57 | 128 | 2008 | 490 |
| 9 | 261961 | 948 | EF1a | 864 | 864 | none | 86 | 104 | 94 |

*SEQ ID NO.

TABLE 15

| | A<br>trans-<br>poson | B<br>left<br>SEQ* | C<br>right<br>SEQ* | D<br>Int Seq | E<br>puro<br>pro-<br>moter<br>SEQ* | F<br>GFP<br>pro-<br>moter | G<br>L<br>insu-<br>lator<br>SEQ* | H<br>R<br>insu-<br>lator<br>SEQ* | I<br>RNA | J<br>DNA | K<br>Bombyx<br>Transposase<br>SEQ* | L<br>A600 | M<br>A600 | N<br>A600 | O<br>GFP | P<br>GFP | Q<br>GFP |
|---|---|---|---|---|---|---|---|---|---|---|---|---|---|---|---|---|---|
| 1 | 194094 | 23 | 29 | 5'-TTAT-3' | 937 | CMV | none | none | yes | no | 1098 | 0.44 | 0.34 | 0.42 | 1947 | 1547 | 1876 |
| 2 | 194094 | 23 | 29 | 5'-TTAT-3' | 937 | CMV | none | none | no | yes | 415 | 0.34 | 0.27 | 0.32 | 1455 | 1240 | 1231 |
| 3 | 194094 | 23 | 29 | 5'-TTAT-3' | 937 | CMV | none | none | no | yes | 457 | 0.28 | 0.34 | 0.30 | 1107 | 1152 | 1213 |
| 4 | 194094 | 23 | 29 | 5'-TTAT-3' | 937 | CMV | none | none | no | yes | 417 | 0.30 | 0.30 | 0.34 | 1061 | 950 | 1098 |
| 5 | 194094 | 23 | 29 | 5'-TTAT-3' | 937 | CMV | none | none | no | yes | 412 | 0.31 | 0.33 | 0.35 | 860 | 1049 | 1143 |
| 6 | 194094 | 23 | 29 | 5'-TTAT-3' | 937 | CMV | none | none | no | yes | 416 | 0.32 | 0.29 | 0.35 | 1016 | 910 | 1004 |
| 7 | 194094 | 23 | 29 | 5'-TTAT-3' | 937 | CMV | none | none | no | yes | 407 | 0.31 | 0.30 | 0.30 | 943 | 800 | 866 |
| 8 | 194094 | 23 | 29 | 5'-TTAT-3' | 937 | CMV | none | none | no | no | N/A | 0.02 | 0.04 | 0.04 | 150 | 171 | 167 |
| 9 | 240671 | 22 | 30 | 5'-TTAA-3' | 937 | CMV | none | none | yes | no | 1098 | 0.48 | 0.44 | 0.26 | 2177 | 1757 | 1016 |
| 10 | 240671 | 22 | 30 | 5'-TTAA-3' | 937 | CMV | none | none | no | yes | 415 | 0.34 | 0.30 | 0.35 | 1525 | 1480 | 1514 |
| 11 | 240671 | 22 | 30 | 5'-TTAA-3' | 937 | CMV | none | none | no | yes | 457 | 0.29 | 0.34 | 0.31 | 1257 | 1191 | 1144 |
| 12 | 240671 | 22 | 30 | 5'-TTAA-3' | 937 | CMV | none | none | no | yes | 412 | 0.34 | 0.29 | 0.28 | 1001 | 1032 | 897 |
| 13 | 240671 | 22 | 30 | 5'-TTAA-3' | 937 | CMV | none | none | no | yes | 416 | 0.27 | 0.33 | 0.29 | 917 | 874 | 953 |
| 14 | 240671 | 22 | 30 | 5'-TTAA-3' | 937 | CMV | none | none | no | yes | 407 | 0.32 | 0.26 | 0.27 | 1006 | 784 | 885 |
| 15 | 240671 | 22 | 30 | 5'-TTAA-3' | 937 | CMV | none | none | no | yes | 417 | 0.27 | 0.25 | 0.23 | 800 | 859 | 777 |
| 16 | 240671 | 22 | 30 | 5'-TTAA-3' | 937 | CMV | none | none | no | no | N/A | 0.03 | 0.17 | 0.06 | 178 | 261 | 168 |
| 17 | 246143 | 22 | 30 | 5'-TTAA-3' | 942 | CMV | none | none | no | yes | 415 | 0.00 | 0.00 | 0.00 | 102 | 109 | 142 |
| 18 | 246143 | 22 | 30 | 5'-TTAA-3' | 942 | CMV | none | none | no | yes | 412 | 0.00 | 0.00 | 0.00 | 114 | 103 | 107 |
| 19 | 246143 | 22 | 30 | 5'-TTAA-3' | 942 | CMV | none | none | no | yes | 416 | 0.00 | −0.01 | 0.00 | 109 | 102 | 106 |
| 20 | 246143 | 22 | 30 | 5'-TTAA-3' | 942 | CMV | none | none | no | yes | 417 | 0.00 | 0.00 | 0.00 | 106 | 100 | 98 |
| 21 | 246143 | 22 | 30 | 5'-TTAA-3' | 942 | CMV | none | none | no | yes | 407 | 0.00 | −0.01 | 0.00 | 105 | 98 | 101 |
| 22 | 246143 | 22 | 30 | 5'-TTAA-3' | 942 | CMV | none | none | yes | no | 1098 | −0.01 | 0.00 | 0.00 | 99 | 104 | 96 |
| 23 | 246143 | 22 | 30 | 5'-TTAA-3' | 942 | CMV | none | none | no | yes | 457 | 0.00 | 0.00 | 0.00 | 97 | 101 | 100 |
| 24 | 246143 | 22 | 30 | 5'-TTAA-3' | 942 | CMV | none | none | no | no | N/A | 0.00 | 0.00 | 0.00 | 109 | 105 | 104 |
| 25 | 246170 | 22 | 30 | 5'-TTAA-3' | 942 | EF1a | 864 | 860 | no | yes | 415 | 0.18 | 0.00 | 0.04 | 5477 | 162 | 1559 |
| 26 | 246170 | 22 | 30 | 5'-TTAA-3' | 942 | EF1a | 864 | 860 | no | yes | 412 | 0.03 | 0.04 | 0.06 | 1148 | 1589 | 3145 |
| 27 | 246170 | 22 | 30 | 5'-TTAA-3' | 942 | EF1a | 864 | 860 | no | yes | 417 | 0.02 | 0.01 | 0.00 | 637 | 683 | 203 |
| 28 | 246170 | 22 | 30 | 5'-TTAA-3' | 942 | EF1a | 864 | 860 | no | yes | 416 | 0.00 | 0.02 | 0.00 | 146 | 652 | 217 |
| 29 | 246170 | 22 | 30 | 5'-TTAA-3' | 942 | EF1a | 864 | 860 | yes | no | 1098 | 0.00 | 0.01 | 0.00 | 237 | 286 | 118 |
| 30 | 246170 | 22 | 30 | 5'-TTAA-3' | 942 | EF1a | 864 | 860 | no | yes | 457 | 0.00 | 0.00 | 0.00 | 106 | 122 | 115 |
| 31 | 246170 | 22 | 30 | 5'-TTAA-3' | 942 | EF1a | 864 | 860 | no | yes | 407 | 0.00 | 0.00 | 0.00 | 108 | 101 | 113 |
| 32 | 246170 | 22 | 30 | 5'-TTAA-3' | 942 | EF1a | 864 | 860 | no | no | N/A | 0.00 | 0.00 | 0.00 | 108 | 128 | 114 |

*SEQ ID NO.

SEQUENCE LISTING (1110 sequences)

SEQ ID NO: 1 - DNA, 181 bp, Artificial Sequence
  Synthesized
ccctttgcctgccaatcacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 2 - DNA, 181 bp, Xenopus tropicalis
cctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtc

SEQ ID NO: 3 - DNA, 181 bp, Xenopus tropicalis
cctttttactgccaatgacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 4 - DNA, 134 bp, Xenopus tropicalis
cctttttactgccaatgacgcatgggatacgtcgtggcagtaaaagggcttaaatgccaacgacgcgtcccatacgttgttggcattttaagtcttctctctgcagcggcagcatgtgccgccgctgcagagag

SEQ ID NO: 5 - DNA, 96 bp, Xenopus tropicalis
cctttttactgccaatgacgcatgggatacgtcgtggcagtaaaagggcttaaatgccaacgacgcgtcccatacgttgttggcattttaagtctt

SEQ ID NO: 6 - DNA, 96 bp, Xenopus tropicalis
ccctttgcctgccaatcacgcatgggatacgtcgtggcagtaaaagggcttaaatgccaacgacgcgtcccatacgttgttggcattttaagtctt

SEQ ID NO: 7 - DNA, 78 bp, Xenopus tropicalis
ccctttgcctgccaatcacgcatgggatacgtcgtggcagtaaaagggcttaaatgccaacgacgcgtcccatacgtt

SEQ ID NO: 8 - DNA, 185 bp, Artificial Sequence
  Synthesized
ttatcctttttactgccaatgacgcatgggatacgtcgtggcagtaaaagggcttaaatgccaacgacgcgtcccatacgttgttggcattttaagtcttctctctgcagcggcagcatgtgccgccgctgcagagagtttctagcgatgacagcccctctgggcaacgagccgggggggctgtc

SEQ ID NO: 9 - DNA, 64 bp, Artificial sequence
  Synthesized
atcacgcatgggatacgtcgtggcagtaaaagggcttaaatgccaacgacgcgtcccatacgtt

SEQ ID NO: 10 - DNA, 82 bp, Artificial sequence
  Synthesized
atgacgcatgggatacgtcgtggcagtaaaagggcttaaatgccaacgacgcgtcccatacgttgttggcattttaagtctt

SEQ ID NO: 11 - DNA, 234 bp, Artificial sequence
  Synthesized
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgggacaaatcggctggcagtgaaaggg

SEQ ID NO: 12 - DNA, 233 bp, Xenopus tropicalis
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaaggg

SEQ ID NO: 13 - DNA, 148 bp, Xenopus tropicalis
ttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaaggg

SEQ ID NO: 14 - DNA, 237 bp, Artificial sequence
  Synthesized
tttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttat

SEQ ID NO: 15 - DNA, 149 bp, Xenopus tropicalis
ttgttctgaaaaaaacaatatattgttttcctgggtaaactaaaagtcccctcgaggaaaggcccctaaagtgaaacagtgcaaaacgttcaaaaactgtctggcaatacaagttccactttgggacaaatcggctggcagtgaaaggg

SEQ ID NO: 16 - DNA, 120 bp, Xenopus tropicalis
cctgggtaaactaaaagtcccctcgaggaaaggcccctaaagtgaaacagtgcaaaacgttcaaaaactgtctggcaatacaagttccactttgggacaaatcggctggcagtgaaaggg

SEQ ID NO: 17 - DNA, 106 bp, Artificial sequence
  Synthesized
cctgggtaaactaaaagtcccctcgaggaaaggcccctaaagtgaaacagtgcaaaacgttcaaaaactgtctggcaatacaagttccactttgggacaaatcggc

SEQ ID NO: 18 - DNA, 134 bp, Artificial sequence
  Synthesized
ttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggc

SEQ ID NO: 19 - DNA, 14 bp, Artificial sequence
  Synthesized
ccytttbmctgcca

SEQ ID NO: 20 - DNA, 14 bp, Artificial sequence
  Synthesized
ccctttgcctgcca

SEQ ID NO: 21 - DNA, 14 bp, Artificial sequence
  Synthesized
tggcagtgaaaggg

SEQ ID NO: 22 - DNA, 371 bp, Bombyx mori
cccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaa

SEQ ID NO: 23 - DNA, 371 bp, Bombyx mori; identical to SEQ ID NO: 22

SEQ ID NO: 24 - DNA, 301 bp, Artificial sequence
  Synthesized
cccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatg

SEQ ID NO: 25 - DNA, 221 bp, Artificial sequence
  Synthesized
cccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtat

SEQ ID NO: 26 - DNA, 285 bp, Artificial sequence
  Synthesized
cagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatg

SEQ ID NO: 27 - DNA, 205 bp, Artificial sequence
  Synthesized
cagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtat

SEQ ID NO: 28 - DNA, 707 bp, Artificial sequence
  Synthesized
tcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataattcattattttacaaaataagatcaacataattgagtaaataataataagaacaatattatagtacaacaaaatatgggtatgtcataccctttttttttttttttttttttttcgggtagagggccgaacctcctacgaggtccccgcgcaaaaggggcgcgcggggtatgtgagactcaacgatctgcatggtgttgtgagcagaccgcgggcccaaggattttagagcccacccactaaacgactcctctgcactcttacacccgacgtccgatcccctccgaggtcagaacccggatgaggtaggggggctaccgcggtcaacactacaaccagacggcgcggctcaccccaaggacgcccagccgacggagccttcgaggcgaatcgaaggctctgaaacgtcggcctcttcctcggtatgtcataccctgccacattcttgatgtaactttttttcacctcatgctcgccggg

SEQ ID NO: 29 - DNA, 364 bp, Artificial sequence
  Synthesized
tcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccggg

SEQ ID NO: 30 - DNA, 364 bp, Artificial sequence; identical to SEQ ID NO: 29
  Synthesized

SEQ ID NO: 31 - DNA, 208 bp, Artificial sequence
  Synthesized
tttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccggg

SEQ ID NO: 32 - DNA, 192 bp, Artificial sequence
  Synthesized
tttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttca

SEQ ID NO: 33 - DNA, 16 bp, Artificial sequence
  Synthesized
cccggcgagcatgagg

SEQ ID NO: 34 - DNA, 16 bp, Artificial sequence
  Synthesized
cctcatgctcgccggg

SEQ ID NO: 35 - DNA, 309 bp, Trichoplusia ni
ccctagaaagatagtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatc

SEQ ID NO: 36 - DNA, 231 bp, Trichoplusia ni
tttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgattatctttctaggg

SEQ ID NO: 37 - DNA, 309 bp, Trichoplusia ni; identical to SEQ ID NO: 35

SEQ ID NO: 38 - DNA, 231 bp, Trichoplusia ni; identical to SEQ ID NO: 36

SEQ ID NO: 39 - DNA, 2158 bp, Artificial sequence
  Synthesized
gccttctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtccgccaccggacgtcttcacacccaagctgctagagccgccaccatgatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagggcacatctgagggcaggggaagtctgctaacatgcggggacgtggaggaaaatcccggccccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatgagaagactgaaaactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaacatc

SEQ ID NO: 40 - DNA, 8051 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggctgtcttcgcaggagcccgggctgggcataaaagtcagggcagagccatctattgcttacatttgcttctgacacaactgtgttcactagcaacctcaaacagacaccatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaagaagacagaaaagcgtcttcctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatctcagtggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctcaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatatt

SEQ ID NO: 41 - DNA, 2110 bp, Artificial sequence
  Synthesized
gccttctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgagagcagcggccgggaaggggcggtgcgggaggcggggtgtggggcggtagtgtgggccctgttcctgcccgcgcggtgttccgcattctgcaagcctccggagcgcacgtccgtctcaggggcttcgcaggtacacccaagctgtctagagccgccaccatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagggcacatctgagggcaggggaagtctgctaacatgcggggacgtggaggaaaatcccggccccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatgagaagactgaaaactcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaacatc

SEQ ID NO: 42 - protein, 236 aa, Artificial sequence
  Synthesized
MTALTEGAKLFEKEIPYITELEGDVEGMKFIIKGEGTGDATTGTIKAKYICTTGDLPVPWATLVSTLSYGVQCFAKYPSHIKDFFKSAMPEGYTQERTISFEGDGVYKTRAMVTYERGSIYNRVTLTGENFKKDGHILRKNVAFQCPPSILYILPDTVNNGIRVEFNQAYDIEGVTEKLVTKCSQMNRPLAGSAAVHIPRYHHITYHTKLSKDRDERRDHMCLVEVVKAVDLDTYQ

SEQ ID NO: 43 - DNA, 2984 bp, Artificial sequence
  Synthesized
agcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtttggctcaggcgcaatcacgaatgaataacggtttggttgatgcgagtgattttgatgacgagcgtaatggctggcctgttgaacaagtctggaaagaaatgcacaaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 44 - DNA, 2849 bp, Artificial sequence
  Synthesized
agcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 45 - DNA, 3221 bp, Artificial sequence
  Synthesized
cgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgggtaaggaaaagactcacgtttcgaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggcaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtttggctcaggcgcaatcacgaatgaataacggtttggttgatgcgagtgattttgatgacgagcgtaatggctggcctgttgaacaagtctggaaagaaatgcacaaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 46 - DNA, 3170 bp, Artificial sequence
  Synthesized
agcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttatcccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttatcggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 47 - DNA, 3170 bp, Artificial sequence
  Synthesized
agcttttcaattcaattcatcattttttttttattcttttttttgatttcggtttctttgaaatttttttgattcggtaatctccgaacagaaggaagaacgaaggaaggagcacagacttagattggtatatatacgcatatgtagtgttgaagaaacatgaaattgcccagtattcttaacccaactgcacagaacaaaaaccagcaggaaacgaagataaatcatgtcgaaagctacatataaggaacgtgctgctactcatcctagtcctgttgctgccaagctatttaatatcatgcacgaaaagcaaacaaacttgtgtgcttcattggatgttcgtaccaccaaggaattactggagttagttgaagcattaggtcccaaaatttgtttactaaaaacacatgtggatatcttgactgatttttccatggagggcacagttaagccgctaaaggcattatccgccaagtacaattttttactcttcgaagatagaaaatttgctgacattggtaatacagtcaaattgcagtactctgcgggtgtatacagaatagcagaatgggcagacattacgaatgcacacggtgtggtgggcccaggtattgttagcggtttgaagcaggcggcagaagaagtaacaaaggaacctagaggccttttgatgttagcagaattgtcatgcaagggctccctatctactggagaatatactaagggtactgttgacattgcgaaaagcgacaaagattttgttaacccggcgagcatgaggcagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtattttttttatgtaatttttccgattattaatttcaactgttttattggtatttttatgttatccattgttctttttttatgatttactgtatcggttgtctttcgttcctttagttgagtttttttttattattttcagtttttgatcaaagtttagcttgcctcgtccccgccgggtcacccggccagcgacatggaggcccagaataccctccttgacagtcttgacgtgcgcagctcaggggcatgatgtgactgtcgcccgtacatttagcccatacatccccatgtataatcatttgcatccatacattttgatggccgcacggcgcgaagcaaaaattacggctcctcgctgcagaccagcgagcagggaaacgctcccctcacagacgcgttgaattgtccccacgccgcgcccctgtagagaaatataaaaggttaggatttgccactgaggttcttctttcatatacttccttttaaaatcttgctaggatacagttctcacatcacatccgaacataaacaacaatgtctgttattaatttcacaggtagttctggtccattggtgaaagtttgcggcttgcagagcacagaggccgcagaatgtgctctagattccgatgctgacttgctgggtattatatgtgtgcccaatagaaagagaacaattgacccggttattgcaaggaaaatttcaagtcttgtaaaagcatataaaaatagttcaggcactccgaaatacttggttggcgtgtttcgtaatcaacctaaggaggatgttttggctctggtcaatgattacggcattgatatcgtccaactgcatggagatgagtcgtggcaagaataccaagagttcctcggtttgccagttattaaaagactcgtatttccaaaagactgcaacatactactcagtgcagcttcacagaaacctcattcgtttattcccttgtttgattcagaagccggtgggacaggtgaacttttggattggaactcgatttctgactgggttggaaggcaagagagccccgaaagcttacattttatgttagctggtggactgacgccagaaaatgttggtgatgcgcttagattaaatggcgttattggtgttgatgtaagcggaggtgtggagacaaatggtgtaaaagactctaacaaaatagcaaatttcgtcaaaaatgctaagaaatagtcagtactgacaataaaaagattcttgttttcaagaacttgtcatttgtatagtttttttatattgtagttgttctattttaatcaaatgttagcgtgatttatattttttttcgcctcgacatcatctgcccagatgcgaagttaagtgcgcagaaagtaatatcatgcgtcaatcgtatgtgaatgctggtcgctatactgctgtcgattcgatactaacgccgccatccagtgtcgaaacgctatgatccaatatcaaaggatcatatttttagtttaaaaaaataattatatgttttataatgaaaagaatctcattatctttcagtattaggttgatttatattccaaagaataatatttttgttaaattgttgatttttgtaaacctctaaatgtttgttgctaaaattactgtgtttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttcacctcatgctcgccgggttaacggctttattgctcaaagagacatgggtggaagagatgaaggttacgattggttgattatgacacccggtgtgggtttagatgacaagggagatgcattgggtcaacagtatagaaccgtggatgatgttgtctctacaggatctgacattattattgttggaagaggactatttgcaaagggaagggatgctaaggtagagggtgaacgttacagaaaagcaggctgggaagcatatttgagaagatgcggccagcaaaactaaaaaactgtattataagtaaatgcatgtatactaaactcacaaattagagcttcaatttaattatatcagttattaccc

SEQ ID NO: 48 - protein, 589 aa, Xenopus tropicalis
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 49 - protein, 589 aa, Xenopus tropicalis
MAKRFYSAEEAAAHCMAPSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWNTTTVLSIPVFSATMSRNRYQLLLRFLHFNNNATAVPPDQPDHDRLHKLRPLIDSLSERFAAVYTPCQNICIDESLLLFKGRLRFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRTRKGLPRALLDKKLNRGETYALRKNELLAIKFFDKKNVFMLTSIHDESVIREQRVGRPPKNKPLCSKEYSKYMGGVDRTDQLQHYYNATRKTSAWYKKVGIYLIQMALRNSYIVYKAAVPGPKLSYYKYQLQILPALLFGGVEEQTVPEMLPSDNVARLIGKHFIDTLPPTPGKQRPQKGCKVCRKRGIRRDTRYYCPKCPRNPGLCFKPCFEIYHTQLHY

SEQ ID NO: 50 - DNA, 1794 bp, Xenopus tropicalis
atggcacccaaaaagaaacgtaaagtgatggccaaaagattttacagcgccgaagaagcagcagcacattgcatggcatcgtcatccgaagaattctcggggagcgattccgaatatgtcccaccggcctcggaaagcgattcgagcactgaggagtcgtggtgttcctcctcaactgtctcggctcttgaggagccgatggaagtggatgaggatgtggacgacttggaggaccaggaagccggagacagggccgacgctgccgcgggaggggagccggcgtggggacctccatgcaattttcctcccgaaatcccaccgttcactactgtgccgggagtgaaggtcgacacgtccaacttcgaaccgatcaatttctttcaactcttcatgactgaagcgatcctgcaagatatggtgctctacactaatgtgtacgccgagcagtacctgactcaaaacccgctgcctcgctacgcgagagcgcatgcgtggcacccgaccgatatcgcggagatgaagcggttcgtgggactgaccctcgcaatgggcctgatcaaggccaacagcctcgagtcatactgggataccacgactgtgcttagcattccggtgttctccgctaccatgtcccgtaaccgctaccaactcctgctgcggttcctccacttcaacaacaatgcgaccgctgtgccacctgaccagccaggacacgacagactccacaagctgcggccattgatcgactcgctgagcgagcgattcgccgcggtgtacaccccttgccaaaacatttgcatcgacgagtcgcttctgctgtttaaaggccggcttcagttccgccagtacatcccatcgaagcgcgctcgctatggtatcaaattctacaaactctgcgagtcgtccagcggctacacgtcatacttcttgatctacgaggggaaggactctaagctggacccaccggggtgtccaccggatcttactgtctccggaaaaatcgtgtgggaactcatctcacctctcctcggacaaggctttcatctctacgtcgacaatttctactcatcgatccctctgttcaccgccctctactgcctggatactccagcctgtgggaccattaacagaaaccggaagggtctgccgagagcactgctggataagaagttgaacaggggagagacttacgcgctgagaaagaacgaactcctcgccatcaaattcttcgacaagaaaaatgtgtttatgctcacctccatccacgacgaatccgtcatccgggagcagcgcgtgggcaggccgccgaaaaacaagccgctgtgctctaaggaatactccaagtacatggggggtgtcgaccggaccgatcagctgcagcattactacaacgccactagaaagacccgggcctggtacaagaaagtcggcatctacctgatccaaatggcactgaggaattcgtatattgtctacaaggctgccgttccgggcccgaaactgtcatactacaagtaccagcttcaaatcctgccggcgctgctgttcggtggagtggaagaacagactgtgcccgagatgccgccatccgacaacgtggcccggttgatcggaaagcacttcattgataccctgcctccgacgcctggaaagcagcggccacagaagggatgcaaagtttgccgcaagcgcggaatacggcgcgatacccgctactattgcccgaagtgcccccgcaatcccggactgtgtttcaagccctgttttgaaatctaccacacccagttgcattac

SEQ ID NO: 51 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLNIPVFSATMSRNRYQLLLRFLEFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 52 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCEKPCFEIYHTQLHY

SEQ ID NO: 53 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYMSYFLIYEGKDSKLDPPGCPPDLTVSGKIVWELISPLLGQGFHLYVDNFYSSIPLFTALYVLNTPACGTINRNRKGLPRAILDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 54 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFKQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 55 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIFHTQLHY

SEQ ID NO: 56 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 57 - protein, 589 aa, Artificial sequence
  Synthesized
MAKRFYSAEEAAAHCMASSSEQTSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 58 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 59 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 60 - protein, 589 aa, Artificial sequence
  Synthesized
MAKRFYSAEEAAAHCMASSSEEFSGVDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTALHY

SEQ ID NO: 61 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 62 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 63 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 64 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFKQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRIPCFEIYHTQLHY

SEQ ID NO: 65 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 66 - protein, 589 aa, Artificial sequence
  Synthesized
MAKRFYSAEEAAAHCMASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRAILDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 67 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGKTMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCEKPCFEIYHTQLHY

SEQ ID NO: 68 - protein, 589 aa, Artificial sequence
  Synthesized
MAKRFYGAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYAKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQYHY

SEQ ID NO: 69 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPGDSVARLIGKHFIDTLPPTPGKQRPQKGCKVCRKRGIRRDTRYYCPKCPRNPGLCRKPCFEIYHTQLHY

SEQ ID NO: 70 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMAMRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 71 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 72 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTILSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 73 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 74 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIFHTQLHY

SEQ ID NO: 75 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 76 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYAKYMGGVDRGDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTALHY

SEQ ID NO: 77 - protein, 589 aa, Artificial sequence
  Synthesized
MAKRFYGAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTILSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 78 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARQIGKHFIDTLPPTPGKQRPQKGCKVCRKRGIRRDTRYYCPKCPRNPGLCRKPCFEIYHTQLHY

SEQ ID NO: 79 - protein, 589 aa, Artificial sequence
  Synthesized
MAKRFYSAEEAAAHCMASSSEETSGVDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 80 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 81 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 82 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGVYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTALHY

SEQ ID NO: 83 - protein, 589 aa, Artificial sequence
  Synthesized
MAKRFYSAEEAAAHCMASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMAMRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 84 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDICEMKRFVGLTLAMGLIKANSIESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 85 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 86 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 87 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRAILDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCEKPCFEIYHTQLHY

SEQ ID NO: 88 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTILSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 89 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRLRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 90 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 91 - protein, 589 aa, Artificial sequence
  Synthesized
MAKRFYGAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQYHY

SEQ ID NO: 92 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFKATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 93 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 94 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYAKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 95 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEFPPSDNVARLIGKHFIDTLPPTPGKQRPQKGCKVCRKRGIRRDTRYYCPKCPRNPGLCRKPCFEIYHTQLHY

SEQ ID NO: 96 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDICEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 97 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 98 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYAKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 99 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIFHTQLHY

SEQ ID NO: 100 - protein, 589 aa, Artificial sequence
  Synthesized
MAKRFYGAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPGDNVARLIGKHFIDTLPPTPGKQRPQKGCKVCRKRGIRRDTRYYCPKCPRNPGLCRKPCFEIYHTQLHY

SEQ ID NO: 101 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFERYHTQLHY

SEQ ID NO: 102 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDICEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 103 - protein, 589 aa, Artificial sequence
  Synthesized
MAKRFYSAEEAAAHCMASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFEDTLPPTPGKQRPQKGCKVCRKRGIRRDTRYYCPKCPRNPGLCRKPCFEIYHTQLHY

SEQ ID NO: 104 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 105 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 106 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 107 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 108 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 109 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRKPCFEIYHTQLHY

SEQ ID NO: 110 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 111 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 112 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEFPPSDNVARLIGKHFIDTLPPTPGKQRPQKGCKVCRKRGIRRDTRYYCPKCPRNPGLCRKPCFEIYHTQLHY

SEQ ID NO: 113 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 114 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPGSDNVARLIGKHFIDTLPPTPGKQRPQKGCKVCRKRGIRRDTRYYCPKCPRNPGLCRKPCFEIYHTQLHY

SEQ ID NO: 115 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPMLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPKLLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 116 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 117 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 118 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 119 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 120 - protein, 589 aa, Artificial sequence; identical to SEQ ID NO: 59
  Synthesized

SEQ ID NO: 121 - protein, 589 aa, Artificial sequence
  Synthesized
MAKRFYSAEEAAAHCMASSSEEFSGVDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFKQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 122 - protein, 589 aa, Artificial sequence
  Synthesized
MAKRFYSAEEAAAHCMASSSEEFSGVDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 123 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 124 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 125 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 126 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 127 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRKPCFEIYHTQLHY

SEQ ID NO: 128 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 129 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 130 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPGDNVARLIGKHFIDTLPPTPGKQRPQKGCKVCRKRGIRRDTRYYCPKCPRNPGLCRKPCFEIYHTALHY

SEQ ID NO: 131 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 132 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 133 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 134 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 135 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRKPCFEIYHTQLHY

SEQ ID NO: 136 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 137 - protein, 589 aa, Artificial sequence
  Synthesized
MAKRFYSAEEAAAHCMASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLYGKHFIDTLPPTPGKQRPQKGCKVCRKRGIRRDTRYYCPKCPRNPGLCRKPCFEIYHTQLHY

SEQ ID NO: 138 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 139 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRIPCFEIYHTQLHY

SEQ ID NO: 140 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSLESYWDTTTVLSIPVFGKTMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 141 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFKQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMAMRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 142 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 143 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 144 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 145 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLYGKHFIDTLPPTPGKQRPQKGCKVCRKRGIRRDTRYYCPKCPRNPGLCRKPCFEIYHTQYHY

SEQ ID NO: 146 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 147 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRKPCFEIYHTQLHY

SEQ ID NO: 148 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGKTMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRAILDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 149 - protein, 589 aa, Artificial sequence
  Synthesized
MAKRFYSAEEAAAHCMASSSEEFSGSDSEYVPPASESDSSTEESWCSSSTVSALEEPMEVDEDVDDAEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 150 - protein, 589 aa, Artificial sequence; identical to SEQ ID NO: 144
  Synthesized

SEQ ID NO: 151 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSVESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 152 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRKPCFEIYHTQLHY

SEQ ID NO: 153 - protein, 589 aa, Artificial sequence
  Synthesized
MAKRFYSAEEAAAHCSASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLYGKHFIDTLPPTPGKQRPQKGCKVCRKRGIRRDTRYYCPKCPRNPGLCRKPCFEIYHTQLHY

SEQ ID NO: 154 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFKATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFERYHTQLHY

SEQ ID NO: 155 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 156 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 157 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 158 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 159 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 160 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 161 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSVESYWDTTTVLSIPVFSATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 162 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 163 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 164 - protein, 589 aa, Artificial sequence
  Synthesized
MAKRFYSAEEAAAHCSASSSDQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 165 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFSATMSRNRYQLLLRFLHFNNNATAVPPDQPGHDRLHKVRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCAKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 166 - protein, 589 aa, Artificial sequence; identical to SEQ ID NO: 158
  Synthesized

SEQ ID NO: 167 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFKATMSRNRYQLLLRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRLRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 168 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 169 - protein, 589 aa, Artificial sequence; identical to SEQ ID NO: 135
  Synthesized

SEQ ID NO: 170 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRIPCFEIYHTQLHY

SEQ ID NO: 171 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQALTQNPLTRYARAHAWHPTDIAEMKRFVGLTLAMGLIKKNSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 172 - protein, 589 aa, Artificial sequence
  Synthesized
MAKRFYGAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 173 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRIPCFEIYHTQLHY

SEQ ID NO: 174 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 175 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 176 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 177 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSIESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCEKPCFEIYHTQLHY

SEQ ID NO: 178 - protein, 589 aa, Artificial sequence
  Synthesized
MAKRFYSAEEAAAHCSASSSDQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 179 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 180 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 181 - protein, 589 aa, Artificial sequence
  Synthesized
MAKRFYSAEEAAAHCMASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSLESYWDTTTVLSIPVFKATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 182 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 183 - protein, 589 aa, Artificial sequence
  Synthesized
MAKRFYSAEEAAAHCMASSSEEFSGSDSEYVPPASESDSSTEESWCSSSTVSALEEPMEVDEDVDDAEDQEAGDRADAAAGGEPAWGPPCDFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 184 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 185 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRAILDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLYGKHFIDTLPPTPGKQRPQKGCKVCRKRGIRRDTRYYCPKCPRNPGLCRKPCFEIYHTQLHY

SEQ ID NO: 186 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFEDTLPPTPGKQRPQKGCKVCRKRGIRRDTRYYCPKCPRNPGLCRKPCFEIYHTQLHY

SEQ ID NO: 187 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQYHY

SEQ ID NO: 188 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQQLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVNRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 189 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLKIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 190 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHVIDTLPPTPGKQRPQKGCKVCRKRGIRRDTRYYCPKCPRNPGLCRKPCFEIYHTQLHY

SEQ ID NO: 191 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNKLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQYHY

SEQ ID NO: 192 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEFPPSDSVARLIGKHFIDTLPPTPGKQRPQKGCKVCRKRGIRRDTRYYCPKCPRNPGLCRKPCFEIYHTQLHY

SEQ ID NO: 193 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNKLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 194 - protein, 589 aa, Artificial sequence
  Synthesized
MAKRFYSAEEAAAHCMASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRLRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQYHY

SEQ ID NO: 195 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRGARAHAWYPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 196 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPGSDNVARLIGKHFIDTLPPTPGKQRPQKGCKVCRKRGIRRDTRYYCPKCPRNPGLCRKPCFEIYHTQLHY

SEQ ID NO: 197 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMAMRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTALHY

SEQ ID NO: 198 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 199 - protein, 589 aa, Artificial sequence
  Synthesized
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 200 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKKNSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 201 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLYGKHFIDTLPPTPGKQRPQKGCKVCRKRGIRRDTRYYCPKCPRNPGLCRKPCFEIYHTQLHY

SEQ ID NO: 202 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 203 - protein, 589 aa, Artificial sequence
  Synthesized
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 204 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 205 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRCARAHAWHPTDIAEMKRFVGLTLAMGLIKANSLESYWDTTTELSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 206 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARQIGKHFIDTLPPTPGKQRPQKGCKVCRKRGIRRDTRYYCPKCPRNPGLCRKPCFEIFHTQLHY

SEQ ID NO: 207 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRIPCFEIYHTQLHY

SEQ ID NO: 208 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYMLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 209 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFSATMSRNRYQLLLRFLHFNNNATAVPPDQPQHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPMLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 210 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQALTQNPLTRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 211 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQQLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDRKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQYHY

SEQ ID NO: 212 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYKTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 213 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 214 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKVRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPGSDNVARLIGKHFIDTLPPTPGKQRPQKGCKVCRKRGIRRDTRYYCPKCPRNPGLCRKPCFEIYHTQLHY

SEQ ID NO: 215 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCDFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYMLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 216 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTHLYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQYHY

SEQ ID NO: 217 - protein, 589 aa, Artificial sequence
  Synthesized
MAKRFYSAEEAAAHCMASSGEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRQWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQWHY

SEQ ID NO: 218 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQYHY

SEQ ID NO: 219 - protein, 589 aa, Artificial sequence
  Synthesized
MAKRFYSAEEAAAHCMASSSEEFSGSDSEYVPPASESDSSTEESWCSSSTVSALEEPMEVDEDVDDAEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPMLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 220 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRLRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 221 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYKTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 222 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCDFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLQGKHFIDTLPPTPGKQRPQKGCKVCRKRGIRRDTRYYCPKCPRNPGLCRKPCFEIYHTQLHY

SEQ ID NO: 223 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTKPPTPGKQRPQKGCKVCRKRGIRRDTRYYCPKCPRNPGLCRKPCFEIYHTQLHY

SEQ ID NO: 224 - protein, 589 aa, Artificial sequence
  Synthesized
MAKRFYGAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 225 - protein, 589 aa, Artificial sequence
  Synthesized
MAKRFYSAEEAAAHCMASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTILSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 226 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTILSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMAMRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 227 - protein, 589 aa, Artificial sequence
  Synthesized
MAKRFYGAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFNNVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQYHY

SEQ ID NO: 228 - protein, 592 aa, Artificial sequence
  Synthesized
MAKRFYSAEEAAAHCMASSQEEFSGSDSEYVPPASESDSSTEESWCSSSTVSALEEPMEVDEDVDDLEDQEAGDRVDAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKKNSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 229 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDLTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 230 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATATPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 231 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMARNRYQLLLRFLHFNNNATAVPPDQPQHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 232 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNTLPRYARAHAWHPTDIAEMKRFVGLTLAMGLIKANSLESYWDTTTVHSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQEVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 233 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYVIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFERYHTQLHY

SEQ ID NO: 234 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQEQHYYNATRKTRHWYKKVGIYLIQMALRNSYIVYKAAVPGPKLSYYKYMLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 235 - protein, 589 aa, Artificial sequence; identical to SEQ ID NO: 174
  Synthesized

SEQ ID NO: 236 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAERYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARQIGKHFIDTLPPTPGKQRPQKGCKVCRKRGIRRDTRYYCPKCPRNPGLCRKPCFEIYHTQLHY

SEQ ID NO: 237 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLLQMALRNSYIVYKAAVPGPKLSYYKYQLQILPALLFGGVEEQTVPEMPPSDNVARLIGKHFIDMLPPTPGKQRPQKGCKVCRKRGIRRDTRYYCPKCPRNPGLCRKPCFEIYHTQLHY

SEQ ID NO: 238 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRIPCFEIYHTQLHY

SEQ ID NO: 239 - protein, 589 aa, Artificial sequence
  Synthesized
MAKRFYSAEEAAAHCMASSSEQFSGVDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 240 - protein, 589 aa, Artificial sequence
  Synthesized
MAKRFYSAEEAAAHCMASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYGRAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 241 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCDFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQILPKLLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 242 - protein, 589 aa, Artificial sequence
  Synthesized
MAKRFYSAEEAAAHCMAGSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLLQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 243 - protein, 589 aa, Artificial sequence
  Synthesized
MAKRFYSAEEAAAHCMAGSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDMLPPTPGKQRPQKGCKVCRKRGIRRDTRYYCPKCPRNPGLCRKPCFEIYHTQLHY

SEQ ID NO: 244 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNKLPRYARAHAWHPTDIAEMKRFVGLTLAMGLIKANSLESYWDTGTVHSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 245 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRKPCFEIYHTQLHY

SEQ ID NO: 246 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 247 - protein, 592 aa, Artificial sequence
  Synthesized
MAKRFCSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIATLPPTPGKQRPQKGCKVCRKRGIRRDTRYYCPKCPRNPGLCFKPCFEIYHTQLHYGRR

SEQ ID NO: 248 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHVIDTLPPTPGKQRPQKGCKVCRKRGIRRDTRYYCPKCPRNPGLCRKPCFEIYHTQLHY

SEQ ID NO: 249 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 250 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCDFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNACRKTRHWYKKVGIYLLQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 251 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQEQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 252 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLTRYARAHAWHPTDIAEMKRFVGLTLAMGLIKKNSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 253 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGMGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQWHY

SEQ ID NO: 254 - protein, 589 aa, Artificial sequence
  Synthesized
MAKRFYSAEEAAAHCMASSSEEFNGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDLTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 255 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRCARAHAWHPTDIAEMKRFVGLTLAMGLIKANSLESYWDTTTVLKIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 256 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCAKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 257 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMSLRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 258 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYGRAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFKQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 259 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRIPCFEIYHTQLHY

SEQ ID NO: 260 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 261 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQQLTQNPLPRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWHLISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 262 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRNLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCAKEYSKYMGGVDRTDQLQHYYNACRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 263 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDSVARLIGKHFIDTLPPTPGKQRPQKGCKVCRKRGIRRDTRYYCPKCPRNPGLCRKPCFEIYHTQLHY

SEQ ID NO: 264 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAERYLTQNPLTRYGRAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 265 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLSFLHFNNNATAVPPDQPGHDRLHKLRPLIDSLSERFAAVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 266 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRIPCFEIYHTQLHY

SEQ ID NO: 267 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYMLQILPALLFGGVEEQTVPEMPPSDNVARRQGKHFIDTLPPTPGKQRPQKGCKVCRKRGIRRDTRYYCPKCPRNPGLCRKPCFEIYHTQLHY

SEQ ID NO: 268 - protein, 592 aa, Artificial sequence
  Synthesized
MAKRFYSAEEAAAHCMASSSEEFSGSDQEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNKLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 269 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMARNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPKLLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 270 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDSVARLIGKHFIDTLPPTPGKQRPQKGCKVCRKRGIRRDTRYYCPKCPRNFGLCRKPCFEIYHTQLHY

SEQ ID NO: 271 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSVESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 272 - protein, 589 aa, Artificial sequence
  Synthesized
MAKRFYSAEEAAAHCMASSSEEFSGSDSEYVPPASESDSSTEESWCSSSTVSALEEPMEVDEDVDDAEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMARNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLQGKHFIDTLPPTPGKQRPQKGCKVCRKRGIRRDTRYYCPKCPRNPGLCRKPCFEIYHTQLHY

SEQ ID NO: 273 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPQHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMSLRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 274 - protein, 592 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNVLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIATLPPTPGKQRPQKGCKVCRKRGIRRDTRYYCPKCPRNPGLCFKPCFEIYHTQLHYGRR

SEQ ID NO: 275 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPDDLTVSGKIVWELISPLLGMGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRQWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 276 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRCARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCFDTPACGTINRNRKGLPRALLDKKLNRGETYALRKNELLAIKFFDKKNVFMLTSIHDESVIREQRVGRPPKNKPLCSKEYSKYMGGVDRTDQVQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 277 - protein, 589 aa, Artificial sequence
  Synthesized
MAKRFYGAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 278 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRLRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPGDNVARLIGKHFIDTLPPTPGKQRPQKGCKVCRKRGIRRDTRYYCPKCPRNPGLCRKPCFEIYHTQLHY

SEQ ID NO: 279 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 280 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYKTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 281 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFINTLPPTPGKQRPQKGCKVCRKRGIRRDTRYYCPKCPRNPGLCRKPCFEIYHTQLHY

SEQ ID NO: 282 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAERYLTQNPLTRGARAHAWHPTDIAEMKRFVGLTLAMGLIKANSLESYWDTTTVLSIPVFGKTMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 283 - protein, 589 aa, Artificial sequence
  Synthesized
MAKRFYSAEEAAAHCMAGSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLSFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 284 - protein, 589 aa, Artificial sequence
  Synthesized
MAKRFYGAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 285 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYHGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 286 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTWLYCLDTPACGTINRNRKGLPRALLDKKLNRGETYALRKNELLAIKFFDKKNVFMLTSIHDESVIREQRVGRPPKNKPLCSKEYSKYMGGVDRTDQLFHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 287 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARRIGKHVIDTLPPTPGKQRPQKGCKVCRKRGIRRDTRYYCPKCPRNPGLCRKPCFEIYHTQLHY

SEQ ID NO: 288 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIATLPPTPGKQRPQKGCKVCRKRGIRRDTRYYCPKCPRNPGLCRKPCFEIYHTQLHY

SEQ ID NO: 289 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKVRPLIDSLSERFAAVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPKLLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 290 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKVRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYMLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 291 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQQLTQNTLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 292 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIATLPPTPGKQRPQKGCKVCRKRGIRRDTRYYCPKCPRNPGLCRKPCFEIYHTQLHY

SEQ ID NO: 293 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRCARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPACPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 294 - protein, 589 aa, Artificial sequence
  Synthesized
MAKRFYSAEEAAAHCMASSGEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTGTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPDLLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 295 - protein, 592 aa, Artificial sequence
  Synthesized
MAKRFYSAEEAAAHCMASSSEEFSGSDQEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKKNSLESYWDTTTVLSIPVFSATMSRNRYQLLLRFLHFNNNATAVPPDQPGHDRLHKLRPLIDSLSERFAAVYTPCQNICIDESLLLFKGRLLFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 296 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATATPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPMCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQYHY

SEQ ID NO: 297 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAERYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYAKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQYHY

SEQ ID NO: 298 - protein, 589 aa, Artificial sequence
  Synthesized
MAKRFYSAEEAAAHCMASSGEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDMFYSSIPLFTHLYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 299 - protein, 589 aa, Artificial sequence
  Synthesized
MAKRFYSAEEAAAHCMAGSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARRIGKHFIDTLPPTPGKQRPQKGCKVCRKRGIRRDTRYYCPKCPRNPGLCRKPCFEIYHTQLHY

SEQ ID NO: 300 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKVRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLHRKPCFEIYHTQLHY

SEQ ID NO: 301 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDRKLDPPGCPPDLTVSGKIVWELISPLLGQGFHLYVDNFYSSIPLFTALYCEDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 302 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFEDTLPPTPGKQRPQKGCKVCRKRGIRRDTRYYCPKCPRNPGLCRKPCFEIYHTQLHY

SEQ ID NO: 303 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIWEMKRFVGLTLAMGLIKANSLESYWDTTTVLSIPVFSATMSRNRYQLLLRFLHFNNNATATPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRQWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 304 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIATLPPTPGKQRPQKGCKVCRKRGIRRDTRYYCPKCPRNPGLCRKPCFEIYHTQLHY

SEQ ID NO: 305 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRNLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDLTDQLQHYYNATRKTRHWYKKVGIYLIQMALRNSYIVYKAAVPGPKLSYYKYQLQILPALLFGGVEEQTVPEMPPSDNVARLQGKHFIDTLPPTPGKQRPQKGCKVCRKRGIRRDTRYYCPKCPRNPGLCRKPCFEIYHTQLHY

SEQ ID NO: 306 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCAKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFVIYHTQLHY

SEQ ID NO: 307 - protein, 589 aa, Artificial sequence
  Synthesized
MAKRFYSAEEAAAHCMASSSEEFNGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRNLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTFPPTPGKQRPQKGCKVCRKRGIRRDTRYYCPKCPRNPGLCRKPCFEIYHTQLHY

SEQ ID NO: 308 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRANAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKKNSLESYWDTTTVLNIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 309 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPMCSKEYSKYMGGVDRTDQLFHYYNATRKTRQWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 310 - protein, 592 aa, Artificial sequence
  Synthesized
MAKRFYSAEEAAAHCMASSSEEFSGSDSEYKPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIVEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 311 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLIFRQYIPSKRARYGIKFYKLCESSSGYTSYFLIYEGKDSKLDPPGCPPDLTVSGKIVWHLISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 312 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPDDLTVSGKIVWELISPLLGQGFHLYVDNFYSSIPLFTALYCLSTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 313 - protein, 589 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFNNVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNFGLCRKPCFEIYHTQYHY

SEQ ID NO: 314 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDLTDQLQHYYNACRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 315 - protein, 589 aa, Artificial sequence
  Synthesized
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLQGKHFIDTLPPTPGKQRPQKGCKVCRKRGIRRDTRYYCPKCPRNPGLHRKPCFEIYHTQLHY

SEQ ID NO: 316 - protein, 592 aa, Artificial sequence
  Synthesized
MAKRFYSAEEAAAHCMASSDEEFSGSDSEYVPPASESDSSTEESWCSSSTVSALEEPMEVDEDVDDLEDQEAGDRANAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 317 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQQLTQNPLPRYARAHAWHPTDIAEMKRFVGLTLAMGLIKANSLESYWDTTTVHSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWVLISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 318 - protein, 592 aa, Artificial sequence
  Synthesized
MAKRFYSAEEAAAHCMASSDEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNKLPRYARAHAWHPTDIAEMKRFVGLTLAMGLIKANSLESYWDTTTVLSIPVFSAWMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 319 - protein, 592 aa, Artificial sequence
  Synthesized
MAKRFYSAEEAAAHCMASSDEEFSGSDSEYVPPESESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLNIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 320 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLKIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPDLLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 321 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 322 - protein, 592 aa, Artificial sequence
  Synthesized
MAKRFYSADEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSAWMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 323 - protein, 589 aa, Artificial sequence
  Synthesized
MAKRFYSAEEAAAHCMASSSEEFNGSDSEYVPPASESDSSTEESWCSSSTVSALEEPMEVDEDVDDAEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLHRKPCFEIYHTQLHY

SEQ ID NO: 324 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYKTQNPLTRYARAHAWHPTDIAEMKRFVGLTLAMGLIKANSLESYWDTTTVLSIPVFSATMARNRYQLLLRNLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 325 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPQHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLHRKPCFEIYHTQLHY

SEQ ID NO: 326 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCFDTPACGTINRNRKGLPRALLDKKLNRGETYALRKNELLAIKFFDKKNVFMLTSIHDESVIREQRVGRPPKNKPLCSKEYSKYMGGVDRTDQLFHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 327 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRGARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPACPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHNIDTLPPTPGKQRPQKGCKVCRKRGIRRDTRYYCPKCPRNPGLCFKPCFEIYHTQLHY

SEQ ID NO: 328 - protein, 592 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVHSIPVFSATMSRNRYQLLLRFLHFNNNATAVPPDQPGHDRLHKLRPLIDSLSERFAAVYTPCQNICIDESLLLFKGRLLFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 329 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVHSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDRKLDPPGCPPDLTVSGKIVWELISPLLGQGFHLYVDNFYSSIPLFTHLYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 330 - protein, 592 aa, Artificial sequence
  Synthesized
MAKRFYSAEEAAAHCMASSDEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLKFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 331 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMSLRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFVIYHTQLHY

SEQ ID NO: 332 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVNAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 333 - protein, 592 aa, Artificial sequence
  Synthesized
MAKRFYSAEEAAAHCMASSQEEFSGSDQEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAKPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 334 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQALTQNKLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 335 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPIFSAWMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 336 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQALTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVEGPKLSYYKYQLQILPALLFGGVEEQTVPEMPPSDNVARLIGKHNIDTLPPTPGKQRPQKGCKVCRKRGIRRDTRYYCPKCPRNPGLCFKPCFEIYHTQLHY

SEQ ID NO: 337 - protein, 592 aa, Artificial sequence
  Synthesized
MAKRFYSAEEAAAHCMASSSEEPSGSDSEYKPPASESDSSTEESWCSSSTVSALEEPMEVDEDVDDLEDQEAGDRADAAAGGEPAWGAPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 338 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARRIGKHFINTLPPTPGKQRPQKGCKVCRKRGIRRDTRYYCPKCPRNPGLCRKPCFEIYHTQLHY

SEQ ID NO: 339 - protein, 592 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 340 - protein, 592 aa, Artificial sequence
  Synthesized
MAKRFYSAEEAAAHCMASGSEEFSGSDSEYVPPASESDSSTEESWCSSSTVSALEEPMEVDEDVDDLEDQEAGDRVDAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPIMPPSDNVARLIGKHFIDTLPPTPGKQRPQKGCKVCRKRGIRRDTRYYCPKCPRNPGLCFKPCFEIYHTQLHYGRR

SEQ ID NO: 341 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLHRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNFGLCRKPCFEIYHTQLHY

SEQ ID NO: 342 - protein, 589 aa, Artificial sequence
  Synthesized
MAKRFYSAEEAAAHCMASSGEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGMGFHLYVDGFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 343 - protein, 589 aa, Artificial sequence
  Synthesized
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRIPCFEIYHTQLHY

SEQ ID NO: 344 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYKTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPGSDNVARLIGKHFINTLPPTPGKQRPQKGCKVCRKRGIRRDTRYYCPKCPRNPGLCRKPCFEIYHTQLHY

SEQ ID NO: 345 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFKATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFEDTLPPTPGKQRPQKGCKVCRKRGIRRDTRYYCPKCPRNPGLCRKPCFEIYHTQYHY

SEQ ID NO: 346 - protein, 592 aa, Artificial sequence
  Synthesized
MAKRFYSAEEAAAHCMASGSEEFSGSDSEYVPPASESDSSTEESWCSSSTVSALEEPMEVDEDVDDLEDQEAGDRADAAAGGEPAWGAPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 347 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYQGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLFHYYNATRKTRAWYKKVGIYLIQMALRNSYIVYKAAVPGPKLSYYKYQLQILPALLFGGVEEQTVPEMPKSDNVARLIGKHFIDTLPPTPGKQRPQKGCKVCRKRGIRRDTRYYCPKCPRNPGLCFKPCFEIYHTQLHY

SEQ ID NO: 348 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLHRYARAHAWHPTDIAEMKRFVGLTLAMGLIKANSLESYWDTTTVLSIPVFSATMSRNRYQLLLKFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 349 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRANAAAGGEPAWGPPCNFPPEIPPFTTVPGVKVDTSNFEPINFFQLFMTEAILQDMVLYTNVYAEQYLTQEPLPRYARAHAWHPTDIAEMKRFVGLTLAMGLIKANSLESYWDTGTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 350 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGKTMSRNRYQLLLRFLHFNNNATAVPPDQPGHDRLHKLRPLIDSLSERFNNVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 351 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIWEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVNRPPKNKPLCSKEYSKYMGGVDRTDQVQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 352 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMSLRNSYIVYKAAVPGPKLSYYKYQLQILPKLLFGGVEEQTVPEMPPSDNVARLIGKHVIDTLPPTPGKQRPQKGCKVCRKRGIRRDTRYYCPKCPRNPGLCRKPCFEIYHTQLHY

SEQ ID NO: 353 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAERYLTQNPLTRYARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEFPPSDNVARLIGKHFIDTLPPTPGKQRPQKGCKVCRKRGIRRDTRYYCPKCPRNPGLCRKPCFEIYHTQLHY

SEQ ID NO: 354 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNTLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVNRPPKNKPLCSKEYSKYMGGVDRTDQLQHYYNATRKTRAWYKKTGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 355 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYGRAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNFGLCRKPCFEIYHTQLHY

SEQ ID NO: 356 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYHGKDSKLDPPGCPPDLTVSGKIVWELISPLLGQGFHLYVDNFYSSIPLFTALYCLSTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKCGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 357 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKKNSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARQIGKHFIDTLPPTPGKQRPQKGCKVCRKRGIRRDTRYYCPKCPRNPGLCRKPCFERYHTQYHY

SEQ ID NO: 358 - protein, 589 aa, Artificial sequence
  Synthesized
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRSARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTKPPTPGKQRPQKGCKVCRKRGIRRDTRYYCPKCPRNPGLCRKPCFEIYHTQLHY

SEQ ID NO: 359 - protein, 592 aa, Artificial sequence
  Synthesized
MAKRFYSAEEAAAHCMASSSEEFSGSDSEYVPPESESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPGHRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 360 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNTLPRYARAHAWHPTDIAEMKRFVGLTLAMGLIKANSLESYWDTGTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYCKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 361 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTMVPGVKVDTSNFEPINFFQLFMTEAILQDMVLYTNVYAEQYLTQNKLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLLFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 362 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYQGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPRNKPLCSKEYSKYMGGVDRTDQLQHYYNATRKTRAWYKKCGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 363 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPTRNKPLCSKEYSKYMGGVDRTDQLQHYYNATRKTRAWYKKVGIYLIQMALRNSYIVYKAAVPGPKLSYYKYQLQILPALLFGGVEEQTVPEMPYSDNVARLIGKHFIDTLPPTPGKQRPQKGCKVCRKRGIRRDTRYYCPKCPRNPGLCFKPCFEIYHTQLHY

SEQ ID NO: 364 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLSFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQEQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 365 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDGFYSSIPLFTHLYCLDTPACGTINRNRKGLPRALLDKKLNRGETYALRKNELLAIKFFDKKNVFMLTSIHDESVIREQRVGRPTKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 366 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQALTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYHGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALANSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 367 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPGPRYARAHAWHPTDIAEMKRFVGLTLAMGLIKANSLESYWDTTTVLNIPVFSATMSRNRYQLLLRFMHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 368 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDGFYSSIPLFTALYCLDTPACGTINRNRKGLPRALLDKKLNRGETYALRKNELLAIKFFDKKNVFMLTSIHDESVIREQRVNRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 369 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNVLPRYARAHAWHPTDIVEMKRFVGLTLAMGLIKANSLESYWDTTTVLSIPIFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 370 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNENATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWHLISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 371 - protein, 592 aa, Artificial sequence
  Synthesized
MAKRFCSAEEAAAHCMASSSEEFSGSDSEYVPPASESDSSTEESWCSSSTVSALEEPMEVDEDVDDLEDQEAGDRADAAWGGEPAWGPPCNFPPEIPPFTTVPGVKVDTSNFEPINFFQLFMTEAILQDMVLYTNVYAEQYLTQEPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 372 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFINTLPPTPGKQRPQKGCKVCRKRGIRRDTRYYCPKCPRNPGLCRKPCFVIYHTQLHY

SEQ ID NO: 373 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLSFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLLQMALRNSYIVYKAAVPGPKLSYYKYQLQILPALLFGGVEEQTVPEMPPSDNVARLIGKHVIDTLPPTPGKQRPQKGCKVCRKRGIRRDTRYYCPKCPRNPGLCRKPCFEIYHTQLHY

SEQ ID NO: 374 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDMFPPTPGKQRPQKGCKVCRKRGIRRDTRYYCPKCPRNPGLHRKPCFEIYHTQLHY

SEQ ID NO: 375 - protein, 589 aa, Artificial sequence
  Synthesized
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQEVGRPTKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 376 - protein, 589 aa, Artificial sequence
  Synthesized
MAKRFYSAEEAAAHCMASSGEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQEVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPYSDNVARLIGKHFIDTLPPTPGKQRPQKGCKVCRKRGIRRDTRYYCPKCPRNPGLCFKPCFEIYHTQLHY

SEQ ID NO: 377 - protein, 592 aa, Artificial sequence
  Synthesized
MAKRFYSAEEAAAHCMASSDEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPGPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 378 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLKIPVFSATMSRNRYQLLLRFLHFNNNATAVPPDQPGHDRLHKLRPLIDSLSERFAAVYTPCQNICIDESLLLFKGRLIFRQYIPSKRARYGIKFYKLCESSSGYTSYFLIYHGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 379 - protein, 592 aa, Artificial sequence
  Synthesized
MAKRFYSADEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQEVLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 380 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRANAAAGGEPAWGAPCNFPPEIPPFTTVPGVKVDTSNFEPINFFQLFMTEAILQDMVLYTNVNAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 381 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFNNVYTPCQNICIDESLLLFKGRLQFRQYIPSKRARYGIKFYKLCESSSGYTSYFLIYEGKDSKRDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQIVPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 382 - protein, 592 aa, Artificial sequence
  Synthesized
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVNAEQYLTQNPLPRYARAHAWHPTDIAEMKRFVGLTLAMGLIKANSLESYWDTTTVLNIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 383 - protein, 592 aa, Artificial sequence
  Synthesized
MAKRFYSADEAAAHCMASSSEEFSGSDSEYVPPASESDSSTEESWCSSSTVSALEEPMEVDEDVDDLEDQEAGDRADAAAGGEPAWGPPCNFPPEIPPFTMVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPIMPPSDNVARLIGKHFIDTLPPTPGKQRPQKGCKVCRKRGIRRDTRYYCPKCPRNPGLCFKPCFEIYHTQLHYGRR

SEQ ID NO: 384 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPDDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRCDQLQHYYNATRKTRAWYKKVGIYLIQMALRNSYIVYKAAVPGPKLSYYKYQLQILPALLFGGVEEQTVPEMPPSDNVARLPGKHFIDTLPPTPGKQRPQKGCKVCRKRGIRRDTRYYCPKCPRNPGLCFKPCFEIYHTQLHY

SEQ ID NO: 385 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGPKVDTSNFEPINFFQLFMTEAILQDMVLYTNVYAEQYLTQNPLPRYARAHAWHPTDIYEMKRFVGLTLAMGLIKANSLESYWDTTTVLSIPVFSAVMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 386 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPIFSAVMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 387 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFGATMSRNRYQLLLRFLHFNENATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVEGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 388 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPDDLTVSGKIVWHLISPLLGQGFHLYVDNFYSSIPLFTALYCFDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 389 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGAPCNFPPEIPPFTTVPGVKVDTSNFEPINFFQLFMTEAILQDMVLYTNVYAEQYLTQNPLPRYARAHAWHPTDIVEMKRFVGLTLAMGLIKANSLESYWDTTTVLDIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 390 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVHSIPVFSATMSRNRYQLLLRFLHFNNNATAVPPDQPGHDRLHKLRPLIDSLSERFAAVYTPCQNICIDESLLLFKGRLIFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRCDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 391 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTHLYCLSTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHNIDTLPPTPGKQRPQKGCKVCRKRGIRRDTRYYCPKCPRNPGLCFKPCFEIYHTQLHY

SEQ ID NO: 392 - protein, 589 aa, Artificial sequence
  Synthesized
MAKRFYSAEEAAAHCMASSSEETYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRLRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYVIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 393 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLIFRQYIPSKRARYGIKFYKLCESSSGYTSYFLIYEGKDSKLDPPGCPPDLTVSGKIVWELISPLLGQGFHLYVDNFYSSIPLFTALYCENTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 394 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPQHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQEQHYYNATRKTRHWYKKVGIYLIQMALRNSYIVYKAAVPGPKLSYYKYQLQILPALLFGGVEEQTVPEMPPSDNVARLIGKHFIDMLPPTPGKQRPQKGCKVCRKRGIRRDTRYYCPKCPRNPGLCRKPCFEIYHTQLHY

SEQ ID NO: 395 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQEPLHRYARAHAWHPTDIAEMKRFVGLTLAMGLIKANSLESYWDCTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 396 - protein, 592 aa, Artificial sequence
  Synthesized
MAKRFYSAEEAAAHCMASGSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTGTVLSIPVFSATMSRNRYQLLLRFLHFNNNYTAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 397 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTELSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELASPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVEGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 398 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTELSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCEDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPKSDNVARLIGKHFIDTLPPTPGKQRPQKGCKVCRKRGIRRDTRYYCPKCPRNPGLCFKPCFEIYHTQLHY

SEQ ID NO: 399 - protein, 592 aa, Artificial sequence
  Synthesized
MAKRFYSAEEAAAHCMASSSEEFSGSDSEYVPPESESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVHSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIATLPPTPGKQRPQKGCKVCRKRGIRRDTRYYCPKCPRNPGLCFKPCFEIYHTQLHYGRR

SEQ ID NO: 400 - protein, 589 aa, Artificial sequence
  Synthesized
MAKRFYSAEEAAAHCMASSSEEFNGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFINMLPPTPGKQRPQKGCKVCRKRGIRRDTRYYCPKCPRNPGLCRKPCFEIYHTQLHY

SEQ ID NO: 401 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPACPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPRNKPMCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 402 - protein, 589 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDRKLDPPGCPPDLTVSGKIVWELISPLLGQGFHLYVDNFYSSIPLFTALYCLDTPACGTINRLRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLPGKHFIDTLPPTPGKQRPQKGCKVCRKRGIRRDTRYYCPKCPRNPGLCFKPCFEIYHTQLHY

SEQ ID NO: 403 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNVLPRYARAHAWHPTDIAEMKRFVGLTLAMGLIKANSLESYWDTTTVLSIPVFSATMSRNRYQLLLRFLHFNNDATAVPPDQPGHDRLHKLRPLIDSLTERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 404 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAPGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLSIPVFSATMSRNRYQLLLRFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 405 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRVDAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLKFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 406 - protein, 592 aa, Artificial sequence
  Synthesized
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLNIPVFSATMSRNRYQLLLRFLEFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 407 - protein, 610 aa, Bombyx mori
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 408 - DNA, 1857 bp, Bombyx mori
atggcacccaaaaagaaacgtaaagtgatggacattgaaagacaggaagaaagaatcagggcgatgctcgaagaagaactgagcgactactccgacgaatcgtcatcagaggatgaaaccgaccactgtagcgagcatgaggttaactacgacaccgaggaggagagaatcgactctgtggatgtgccctccaactcacgccaagaagaggccaatgcaattatcgcaaacgaatcggacagcgatccagacgatgatctgccactgtccctcgtgcgccagcgggccagcgcttcgagacaagtgtcaggtccattctacacttcgaaggacggcactaagtggtacaagaattgccagcgacctaacgtcagactccgctccgagaatatcgtgaccgaacaggctcaggtcaagaatatcgcccgcgacgcctcgactgagtacgagtgttggaatatcttcgtgacttcggacatgctgcaagaaattctgacgcacaccaacagctcgattaggcatcgccagaccaagactgcagcggagaactcatcggccgaaacctccttctatatgcaagagactactctgtgcgaactgaaggcgctgattgcactgctgtacttggccggcctcatcaaatcaaataggcagagcctcaaagatctctggagaacggatggaactggagtggatatctttcggacgactatgagcttgcagcggttccagtttctgcaaaacaatatcagattcgacgacaagtccacccgggacgaaaggaaacagactgacaacatggctgcgttccggtcaatattcgatcagtttgtgcagtgctgccaaaacgcttatagcccatcggaattcctgaccatcgacgaaatgcttctctccttccgggggcgctgcctgttccgagtgtacatcccgaacaagccggctaaatacggaatcaaaatcctggccctggtggacgccaagaatttctacgtcgtgaatctcgaagtgtacgcaggaaagcaaccgtcgggaccgtacgctgtttcgaaccgcccgtttgaagtcgtcgagcggcttattcagccggtggccagatcccaccgcaatgttaccttcgacaattggttcaccggctacgagctgatgcttcaccttctgaacgagtaccggctcactagcgtggggactgtcaggaagaacaagcggcagatcccagaatccttcatccgcaccgaccgccagcctaactcgtccgtgttcggatttcaaaaggatatcacgcttgtctcgtacgcccccaagaaaaacaaggtcgtggtcgtgatgagcaccatgcatcacgacaacagcatcgacgagtcaaccggagaaaagcaaaagcccgagatgatcaccttctacaattcaactaaggccggcgtcgacgtcgtggatgaactgtgcgcgaactataacgtgtcccggaactctaagcggtggcctatgactctcttctacggagtgctgaatatggccgcaatcaacgcgtgcatcatctaccgcaccaacaagaacgtgaccatcaagcgcaccgagttcatcagatcgctgggtttgagcatgatctacgagcacctccattcacggaacaagaagaagaatatccctacttacctgaggcagcgtatcgagaagcagttgggagaaccaagcccgcgccacgtgaacgtgccggggcgctacgtgcggtgccaagattgcccgtacaaaaaggaccgcaaaaccaaaagatcgtgtaacgcgtgcgccaaacctatctgcatggagcatgccaaatttctgtgtgaaaattgtgctgaactcgattcctccctg

SEQ ID NO: 409 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDISTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMMYEHLHSRNKKKNIPTYLRQRIEKQLGEPVPRHVNVPGRYVRCQDCPYKKDRKTKRSCNACAKPICMEHAKFLCENCAELDSSL

SEQ ID NO: 410 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFYFLQNNIRFDDKSTLDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCVNCAELDSSL

SEQ ID NO: 411 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 412 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 413 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRERASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSI

SEQ ID NO: 414 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 415 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 416 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAMQLGEPSPRHVNVPGRYVRCQDCPYKKDRKTKRSCNACAKPICMEHAKFLCENCAELDSSL

SEQ ID NO: 417 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKTQIPENFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 418 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGAYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 419 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFGFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 420 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVTDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 421 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKALALVDAKNFYVKNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 422 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 423 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAANFYVKNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 424 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYVGKQPHGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAELDSSL

SEQ ID NO: 425 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYTVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELNSSL

SEQ ID NO: 426 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAELNSSL

SEQ ID NO: 427 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPHGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSI

SEQ ID NO: 428 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFGFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 429 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYLAGLIKSNRQSAKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 430 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDACNFYVTNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 431 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGGFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDSTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 432 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPCYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFQFLQNNIRFDDKSTRDERVQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAELDSSL

SEQ ID NO: 433 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAMQLGEPSPRHVNVPGRYVRCQDCPYKKDRKTKRSCNACAKPICMEHAKFLCENCAELDSSI

SEQ ID NO: 434 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELCSSI

SEQ ID NO: 435 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPCYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 436 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFHFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 437 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELCSSL

SEQ ID NO: 438 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDSTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELDSSL

SEQ ID NO: 439 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIFTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAELDSSL

SEQ ID NO: 440 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDSTGVDIFRTTMSLQRFQFLQNNIRFDDKSTRDERVQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 441 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTLRKNKRQIPESFIRTDRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELDSSL

SEQ ID NO: 442 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDSTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRGFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 443 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSWL

SEQ ID NO: 444 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGGFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFGFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 445 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYVGKQPSGAYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 446 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRNVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 447 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTLRKNKRQIPESFIFTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 448 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKTQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSWL

SEQ ID NO: 449 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIKEHLHSRNKKKNIPTYLRQRIEKQLGEPSPRHVNYPGRYVRCQDCPYKKDRKTKRSCNACAKPICMEHAKFLCENCAELDSSL

SEQ ID NO: 450 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERVQTDNMAAFRSIFDQFVQSCQNAYSPSEFLTIDEMLLSFRGRCLFRVYIPNKPAKYGIKILALVDAKNFYTKNLEVYAGKQPSGPYAVSNRGFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 451 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKTQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 452 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRNVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAANFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 453 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGVIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYELMLHLLNEYRLTSVGTVRKNKRQIPESFIRTDRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 454 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSAKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPENFIRTDRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 455 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 456 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSI

SEQ ID NO: 457 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 458 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPENFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSI

SEQ ID NO: 459 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYTKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELCSSL

SEQ ID NO: 460 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 461 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPCYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 462 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRADGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPHGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELDSSL

SEQ ID NO: 463 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYVGKQPSGPYAVSNRGFEVVERLIQPVARSHRNVTFDNWFTGYELMLHLLNEYRLTSVGTVRKNKRQIPENFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 464 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRNVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 465 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPAGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLYSHL

SEQ ID NO: 466 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELNSSL

SEQ ID NO: 467 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRERASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTLRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 468 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSSL

SEQ ID NO: 469 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGVIKSNRQSLKDLWRTDGTGVDIFRTTMSLQRFGFLQNNIRFDDKSTRDERVQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 470 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRADGTGVDIFRTTMSLQRFHFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 471 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYMAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELDSSL

SEQ ID NO: 472 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVTDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 473 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRNVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTLRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 474 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYMAGLIKSNRQSLKDLWRTDGTGVDIFRTTMSLQRFGFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSWL

SEQ ID NO: 475 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGGFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYMAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 476 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGAYAVSNRPFEVVERLIQPVARSHRNVTFDNWFTGYELMLHLLNEYRLTSVGTVRKNKTQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 477 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSTPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELCSSL

SEQ ID NO: 478 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRERASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERVQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIFTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 479 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFHFLQNNIRFDDKSTRDERVQTDNMAAFRSIFDQFVQSCQNAYSPSEFLTIDEMLLSFRGRCLFRVYIPNKPAKYGIKILALVDAKNFYTKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 480 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPCYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFGFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGAYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 481 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRADGTGVDIFRTTMSLQRFQFLLNNIRFDDKSTRDERVQTDNMAAFRSIFDQFVQSCQNAYSPSEFLTIDEMLLSFRGRCLFRVYIPNKPAKYGIKALALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 482 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFQFLQNNIRFDDKSTRDERVQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPENFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 483 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSSL

SEQ ID NO: 484 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRADGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 485 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFHFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVTDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 486 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 487 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSHL

SEQ ID NO: 488 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNYPGRYVRCQDCPYKKDRKTKRSCNACAKPICMEHAKFLCENCAELHSSL

SEQ ID NO: 489 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSI

SEQ ID NO: 490 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGGFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYMAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 491 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 492 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 493 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSTPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYTKNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELDSSL

SEQ ID NO: 494 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGGFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRADGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 495 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPHGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 496 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHI

SEQ ID NO: 497 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVTDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 498 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 499 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRFVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSI

SEQ ID NO: 500 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFHFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 501 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 502 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRFVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 503 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAKLDSHI

SEQ ID NO: 504 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRERASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVTDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 505 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPAGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 506 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRNVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGVIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEMQLGEPSPRHVNVPGRYVRCQDCPYKKDRKTKRSCNACAKPICMEHAKFLCENCAELDSSL

SEQ ID NO: 507 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 508 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 509 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRVDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPAGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 510 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRFVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPAGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 511 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYELMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 512 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVTNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAKLDSHL

SEQ ID NO: 513 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIFTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELNSHL

SEQ ID NO: 514 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 515 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 516 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAANFYVKNLEVYAGKQPSGPYAVSNRGFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 517 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLYRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 518 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYIAGLIKSNRQSLKDLWRKDGTGVDIFRTTMSLQRFQFLLNNIRFDDISTRDERKQTDNMAAFRSIFDQFVQCCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 519 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 520 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPAGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 521 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFGFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTLRKNKTQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 522 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 523 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSI

SEQ ID NO: 524 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFCFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 525 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 526 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYMAGLIKSNRQSLKDLWRTDGTGVDIFRTTMSLQRFQFLQNNIRFDDKSTRDERVQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 527 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFYFLQNNIRFDDKSTRDERVQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 528 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSTPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 529 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFGFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 530 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYIHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVADELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 531 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSAKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 532 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLYRTDGTGVDIFRTTMSLQRFGFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRGFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 533 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSAKDLWRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 534 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 535 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIAKQLGEPSPRHVNVPGRYVRCQDCPYKKDRKTKRSCNACAKPICMEHAKFLCENCAHLDSSL

SEQ ID NO: 536 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRFVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAKLDSHL

SEQ ID NO: 537 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRERASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKALALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 538 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGVIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSWL

SEQ ID NO: 539 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRERQTKTAAENSSAETSFYMQETTLCELKALIGLLYLAGLIKSNRQSAKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNYPGRYVRCQDCPYKKDRKTKRSCNACAKPICMEHAKFLCENCAELDSSL

SEQ ID NO: 540 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSHL

SEQ ID NO: 541 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRERQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNYPGRYVRCQDCPYKKDRKTKRSCNACAKPICMEHAKFLCENCAELDSHL

SEQ ID NO: 542 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSAKDLWRTDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 543 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 544 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDACNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAKLDSSL

SEQ ID NO: 545 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGAIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSSL

SEQ ID NO: 546 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFGFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGAYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELCSSL

SEQ ID NO: 547 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSHL

SEQ ID NO: 548 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 549 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 550 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSI

SEQ ID NO: 551 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAKLDSSL

SEQ ID NO: 552 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDACNFYIHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 553 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSTPCYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 554 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 555 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPHGPYAVSNRPFEVVERLIQPVARSHRNVTFDNWFTGYELMLHLLNEYRLTSVGTVRKNKRQIPESFIFTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELDSSL

SEQ ID NO: 556 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQLSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLYRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 557 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYIAGLIKSNRQSLKDLWRTDGTGVDIFRTTMSLQRFQFLINNIRFDDKSTRDERKQTDNMAAFRSIFDQFVQCCQNAYSPSEFLTIDEMLLSFRGRCLFRVYIPNKPAKYGIKILALVDAKNWYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 558 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYIHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLYSHL

SEQ ID NO: 559 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLYSSL

SEQ ID NO: 560 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPVPRHVNVPGRYVRCQDCPYKKDRKTKRSCNACAKPICMEHAKFLCENCAELDSSL

SEQ ID NO: 561 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVTNLEVYVGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 562 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFCFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 563 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVADELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 564 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDISTRDERKQTDNMAAFRSIFDQFVQSCQNAYSPSEFLTIDEMLLSFRGRCLFRVYIPNKPAKYGIKILALVDAKNWYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHFNYPGRYVRCQDCPYKKDRKTKRSCNACAKPICMEHAKFLCENCAELDSSL

SEQ ID NO: 565 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELHSSL

SEQ ID NO: 566 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 567 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDACNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVADELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 568 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLYRKDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 569 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFGFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSWL

SEQ ID NO: 570 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSI

SEQ ID NO: 571 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHI

SEQ ID NO: 572 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFGFLQNNIRFDDKSTRDERKQTDNMAAFRSIFDQFVQSCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSHL

SEQ ID NO: 573 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 574 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQLSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRKDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHFNYPGRYVRCQDCPYKKDRKTKRSCNACAKPICMEHAKFLCENCAELDSSL

SEQ ID NO: 575 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSAKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKALALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELNSSL

SEQ ID NO: 576 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRVDGTGVDIFRTTMSLQRFCFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 577 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYIAGLIKSNRQSLKDLWRTDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELHSSL

SEQ ID NO: 578 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 579 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRCNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSSL

SEQ ID NO: 580 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGAIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 581 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 582 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDISTRDERKQTDNMAAFRSIFDQFVQSCQNAYSPSEFLTIDEMLLSFRGRCLFRVYIPNKPAKYGIKILALVDAKNWYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 583 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAMSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 584 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGVIKSNRQSLKDLWRTDGTGVDIFRTTMSLQRFQFLQNNIRFDDKSTRDERVQTDNMAAFRSIFDQFVQSCQNAYSPSEFLTIDEMLLSFRGRCLFRVYIPNKPAKYGIKILALVDAANFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 585 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 586 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLYSHL

SEQ ID NO: 587 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 588 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSAKDLWRTDGTGVDIFRTTMSLQRFYFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 589 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDSTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAANFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 590 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMMYEHLHSRNKKKNIPTYLRQRIEKQLGEPSPRHVNVPGRYVRCQDCPYKKDRKTKRSCNACAKPICMEHAKFLCVNCAELDSSL

SEQ ID NO: 591 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 592 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDKSTRDERVQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 593 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 594 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSSI

SEQ ID NO: 595 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLPELKALIALLYLAGLIKSNRQSLKDLWRTDGTGVDVFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 596 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRERQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 597 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRVDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 598 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 599 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYIHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLALSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 600 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 601 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVTNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 602 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLYSSL

SEQ ID NO: 603 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYFAGLIKSNRQSAKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 604 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 605 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 606 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQLSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 607 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRVDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 608 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCVNCAELDSSL

SEQ ID NO: 609 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYIHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 610 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 611 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 612 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERVQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 613 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDKSTLDERKQTDNMAAFRSIFDQFVQCCQNAYSPSEFLTIDEMLLSFRGRCLFRVYIPNKPAKYGIKILALVDAKNWYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELDSSL

SEQ ID NO: 614 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDISTRDERKQTDNMAAFRSIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 615 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLYRTDGTGVDIFRTTMSLQRFGFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 616 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRERQTKTAAENSSAETSFYMQETTLCELKALIALLYLAGLIKSNRQSLKDLWRTDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 617 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFGFLQNNIRFDDKSTRDERKQTDNMAAFRSIFDQFVQCCQNAYSPSEFLTIDEMLLSFRGRCLFRVYIPNKPAKYGIKILALVDAKNWYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 618 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 619 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLYRTDGTGVDIFRTTMSLQRFGFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 620 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHFNVPGRYVRCQDCPYKKDRKTKRSCNACAKPICMEHAKFLCENCAELDSSL

SEQ ID NO: 621 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTLRKNKRQIPESFIRTDRQPNSSVFGFQKDITLVSYAPKKNKVVVVMSTMHHDNSIDESTGEKQKPEMITFYNSTKAGVDVVDEMCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 622 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRPVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIKTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 623 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRVDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 624 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRLDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 625 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDACNFYVHNLEVYVGKQPSGPYAVSNRPFEVVERLIQPVARSHRNVTFDNWFTGYEVMLHLLNEYRLTSVGTVRKNKRQIPESFIRFDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 626 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 627 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDEMCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 628 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLQGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYDVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 629 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRSDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 630 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGAIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 631 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLYRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 632 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMMYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 633 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYFAGLIKSNRQSLKDLWRTDGTGVDIFRTTMSLQRFQFLQNNIRFDDKSTRDERVQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 634 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTILRQRIEKQLGEPSPRHVNVPGRYVRCQDCPYKKDRKTKRSCNACAKPICMEHAKFLCVNCAELDSSL

SEQ ID NO: 635 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRERQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPRKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIKTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 636 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYNVSRNSKHWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 637 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGAIKSNRQSLKDLWRTDGTGVDIFRTTMSLQRFCFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSHL

SEQ ID NO: 638 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRLMSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLQGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 639 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 640 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQLSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTLRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRLNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 641 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFNFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPVPRHVNVPGRYVRCQDCPYKKDRKTKRSCNACAKPICMEHAKFLCENCAELHSSL

SEQ ID NO: 642 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFCFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVADELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 643 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIALLYLAGLIKSNRQSLKDLYRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAEKDSSL

SEQ ID NO: 644 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPHYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 645 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFQFLLNNIRFDDKSTLDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 646 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCACLDSSL

SEQ ID NO: 647 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTSTAAENSSAETSFYMQETTLCELKALIALLYLAGLIKSNRQSLKDLWRTDGTGVDIFRTTMSLQRFQFLQNNIRFDDKSTRDERVQTDNMAAFRSIFDQFVQCCQNAYSPSEFLTIDEMLLSFRGRCLFRVYIPRKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 648 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTIRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSVL

SEQ ID NO: 649 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKMPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAMLDSSL

SEQ ID NO: 650 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELQANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 651 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRCDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSL

SEQ ID NO: 652 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGTIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRPIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 653 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSTPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLYRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKALALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 654 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELKSSL

SEQ ID NO: 655 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAHTSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPRKPAKYGIKILALVDAKNFYVVNLEVYAGKQPSGPYAVSNRPFEVVERLIQPVARSHRNVTFDNWFTGYELMLHLLNEYRLTSVGTLRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 656 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVPVPGRYVRCQDCKYKKDRKTKRSCNACAKPICMEHAKFLCENCAELDSSL

SEQ ID NO: 657 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDISTRDERKQTDNMAAFRSIFDQFVQCCVNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAWLDSSL

SEQ ID NO: 658 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVTNLEVYVGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVADELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 659 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRPLSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSGRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 660 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRKDGTGVDIFRTTMSLQRFGFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEMQLGEPSPRHVNYPGRYVRCQDCPYKKDRKTKRSCNACAKPICMEHAKFLCENCAELDSSL

SEQ ID NO: 661 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRLVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCACLDSSL

SEQ ID NO: 662 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAHTSFYMQETTLCELKALIALLYLAGLIKSNRQSLKDLWRTDGTGVDIFRTTMSLQRFQFLQNNIRFDDKSTRDERVQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNNSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 663 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAHTSFYMQETTLCELKALIALLYLAGLIKSNRQSLKDLWRTDGTGVDVFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTQRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 664 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRHVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 665 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLQGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWYTGYELMLHLLNEYRLTSVGTVRKNKTQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 666 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLLNNIRFDDKSTRDERVQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 667 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYIAGLIKSNRQSLKDLWRTDGTGVDIFRTTMSLQRFQFVQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMMYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 668 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERVQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIKTDRQPNSSVFGFQKDITLVSYAPKKNKVVVVMSTMHHDNSIDESTGEKFKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 669 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMHAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAWLDSSL

SEQ ID NO: 670 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQMSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDEMCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 671 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRKIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCVNCAEQDSSL

SEQ ID NO: 672 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQLSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIALLYLAGLIKSNRQSLKDLWRKDGTGVDIFRTTMSLQRFQFLLNNIRFDDKSTRDERKQTDNMAAFRSIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 673 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGTIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNWYVVNLEVYAGKQPSGPYAVSNRPFEVVERLIQPVARSHRNVTFDNWFTGYELMLHLLNEYRLTSVGTVRKNKRQIPESFIRTDRQPNNSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 674 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYVGKQPSGPYAVSNRPFEVVERLIQPVARSHRNVTFDNWFTGYEVMLHLLNEYRLTSVGTVRKNKRQIPESFIRFDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIAKQLGEPSPRHVNVPGRYVRCQDCPYKKDRKTKRSCNACAKPICMEHAKFLCENCAHLDSSL

SEQ ID NO: 675 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFGFLLNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSKDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 676 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAHTSFYMQETTLCELKALIALLYLAGLIKSGRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 677 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSAKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKVLALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 678 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTLDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGAKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCKYKKDRKTKRSCNACAKPICMEHAKFLCENCAELDSSL

SEQ ID NO: 679 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRERQTKTAAENSSAETSFYMQETTLCELKALIALLYLAGCIKSNRQSLKDVWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 680 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSKDESTGEKQKPEMITFYNSTKAGVDVVDELCANYNVSRNSKRWPMTLFYGVLNMAAINACIIYRTNKNVTIKRTEFIRSLGLSMMYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 681 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAEQKSHL

SEQ ID NO: 682 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTRNMHAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTWEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 683 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDATGVDIFRTTMSLQRFGFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCKYKKDRKTKRSCNACAKPICMEHAKFLCENCAELDSSL

SEQ ID NO: 684 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSGRQSLKDLWRTDGTGVDIFRTTMSLQRFYFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRPIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 685 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSAKDLYRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDEMCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 686 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTIRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCVNCAELHSSL

SEQ ID NO: 687 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRKIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 688 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRHVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTQRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 689 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAHTSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYDVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCACLDSSL

SEQ ID NO: 690 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTGCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 691 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFNFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYIRCQDCPYKKDRKTKRSCNACAKPICMEHAKFLCENCAELDSSL

SEQ ID NO: 692 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRSDGTGVDIFRTTMSLQRFYFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 693 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMMYEHLHSRNKKKNIPTYLRQRIEKQLGEPVPRHVNYPGRYVRCQDCPYKKDRKTKRSCNACAKPICMEHAKFLCENCAELDSSL

SEQ ID NO: 694 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRKVNYPGRYVRCQDCPYKKDRKTKRSCNACAKPICMEHAKFLCENCAELDSSL

SEQ ID NO: 695 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSSRHVPVPGRYVRCQDCPYKKDRKTKRSCNACAKPICMEHAKFLCENCAELDSSL

SEQ ID NO: 696 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGCIKSNRQSLKDLWRTDGTGVDIFRTTMSLQRFYFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPHSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 697 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTMRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPVPRHVNVPGRYVRCQDCPYKKDRKTKRSCNACAKPICMEHAKFLCENCAELDSHL

SEQ ID NO: 698 - protein, 594 aa, Trichoplusia ni
MGSSLDDEHILSALLQSDDELVGEDSDSEVSDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTSATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRVYIPNKPSKYGIKILMMCDSGTKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPKEVPGTSDDSTEEPVMKKRTYCTYCPSKIRRKANASCKKCKKVICREHNIDMCQSCF

SEQ ID NO: 699 - DNA, 57 bp, Artificial sequence
  Synthesized
agcttgcttgttctttttgcagaagctcagaataaacgctcaactttggccgccacc

SEQ ID NO: 700 - DNA, 166 bp, Artificial sequence
  Synthesized
gatctttttccctctgccaaaaattatggggacatcatgaagccccttgagcatctgacttctggctaataaaggaaatttattttcattgcaaaaaaaaaaaaaaaaaaaaaaaaaaaaaaaaaaaaaaaaaaaaaaaaaaaaaaaaaaaaaaaaaaaaaaaaaa

SEQ ID NO: 701 - protein, 189 aa, Artificial sequence
  Synthesized
MTTLDDTAYRYRTSVPGDAEAIEALDGSFTTDTVFRVTATGDGFTLREVPVDPPLTKVFPDDESDDESDDGEDGDPDSRTFVAYGDDGDLAGFVVVSYSGWNRRLTVEDIEVAPEHRGHGVGRALMGLATEFARERGAGHLWLEVTNVNAPAIHAYRRMGFTLCGLDTALYDGTASDGEQALYMSMPCP

SEQ ID NO: 702 - protein, 124 aa, Artificial sequence
  Synthesized
MAKLTSAVPVLTARDVAGAVEFWTDRLGFSRDFVEDDFAGVVRDDVTLFISAVQDQVVPDNTLAWVWVRGLDELYAEWSEVVSTNFRDASGPAMTEIGEQPWGREFALRDPAGNCVHFVAEEQD

SEQ ID NO: 703 - protein, 373 aa, Artificial sequence
  Synthesized
MATSASSHLNKNIKQMYLCLPQGEKVQAMYIWVDGTGEGLRCKTRTLDCEPKCVEELPEWNFDGSSTFQSEGSNSDMYLSPVAMFRDPFRRDPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKHIEEAIEKLSKRHRYHIRAYDPKGGLDNARRLTGFHETSNINDFSAGVANRSASIRIPRTVGQEKKGYFEDRRPSANCDPFAVTEAIVRTCLLNETGDEPFQYKN

SEQ ID NO: 704 - DNA, 1122 bp, Artificial sequence
  Synthesized
atggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagactaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaa

SEQ ID NO: 705 - protein, 394 aa, Artificial sequence
  Synthesized
MATSASSHLNKNIKQMYLCLPQGEKVQAMYIWVDGTGEGLRCKTRTLDCEPKCVEELPEWNFDGSSTFQSEGSNSDMYLSPVAMFRDPFRRDPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKHIEEAIEKLSKRHRYHIRAYDPKGGLDNARRLTGFHETSNINDFSAGVANRSASIRIPRTVGQEKKGYFEDRRPSANCDPFAVTEAIVRTCLLNETGDEPFQYKNWIRSDMIRYIDEFGQTTTRMQ

SEQ ID NO: 706 - protein, 269 aa, Artificial sequence
  Synthesized
MGKEKTHVSRPRLNSNMDADLYGYKWARDNVGQSGATIYRLYGKPDAPELFLKHGKGSVANDVTDEMVRLNWLTEFMPLPTIKHFIRTPDDAWLLTTAIPGKTAFQVLEEYPDSGENIVDALAVFLRRLHSIPVCNCPFNSDRVFRLAQAQSRMNNGLVDASDFDDERNGWPVEQVWKEMHKLLPFSPDSVVTHGDFSLDNLIFDEGKLIGCIDVGRVGIADRYQDLAILWNCLGEFSPSLQKRLFQKYGIDNPDMNKLQFHLMLDEFF

SEQ ID NO: 707 - protein, 152 aa, Artificial sequence
  Synthesized
MVAISKNGVIGNGPDIPWSAKGEQLLFKAITYNQWLLVGRKTFESMGALPNRKYAVVTRSSFTSDNEDVLIFPSIKDALTNLKKITDHVIVSGGGEIYKSLIDQVDTLHISTIDIEPEGDVYFPEIPSNFRPVFTQDFASNINYSYQIWQKG

SEQ ID NO: 708 - protein, 187 aa, Artificial sequence
  Synthesized
MVRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 709 - protein, 264 aa, Artificial sequence
  Synthesized
MIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKASMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 710 - protein, 267 aa, Artificial sequence
  Synthesized
MGSAIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGDDLVVTHGDACLPNIMVENGRFSGFIDCGRLGVADRYQDIALATRDIAEELGGEWADRFLVLYGIAAPDSQRIAFYRLLDEFF

SEQ ID NO: 711 - protein, 264 aa, Artificial sequence [sequence omitted]

SEQ ID NO: 712 - protein, 264 aa, Artificial sequence
  Synthesized
MVEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 713 - protein, 199 aa, Artificial sequence
  Synthesized
MTEYKPTVRLATRDDVPRAVRTLAAAFADYPATRHTVDPDRHIERVTRAARTLPHARRARHRQGVGRATRRRGGGLDHAGERRSGGGVRRDRNAHGRVERFPAGRAATDGRPPGAAPAQGARVVPGHRRRLARPPGQGSGQRRRAPRSGGGRARRGARLPGDLRAPQPPFYERLGFTVTADVECPKDRATWCMTRKPGA

SEQ ID NO: 714 - protein, 199 aa, Artificial sequence
  Synthesized
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVECPKDRATWCMTRKPGA

SEQ ID NO: 715 - protein, 199 aa, Artificial sequence
  Synthesized
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 716 - DNA, 600 bp, Artificial sequence
  Synthesized
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgatataggtaaggtatgggtggcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 717 - protein, 341 aa, Artificial sequence
  Synthesized
MDRSGKPELTATSVEKFLIEKFDSVSDLMQLSEGEESRAFSFDVGGRGYVLRVNSCADGFYKDRYVYRHFASAALPIPEVLDIGEFSESLTYCISRRAQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPR

SEQ ID NO: 718 - protein, 341 aa, Artificial sequence
  Synthesized
MKKPELTATSVEKFLIEKFDSVSDLMQLSEGEESRAFSFDVGGRGYVLRVNSCADGFYKDRYVYRHFASAALPIPEVLDIGEFSESLTYCISRRAQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPRAKE

SEQ ID NO: 719 - DNA, 1180 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtg

SEQ ID NO: 720 - DNA, 1807 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcagatcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggacacgctgtcgaacttttcgatcagaaacttctcgacagacgtcgcggtgagttcaggctttttcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtg

SEQ ID NO: 721 - DNA, 1906 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtg

SEQ ID NO: 722 - DNA, 2449 bp, Artificial sequence
  Synthesized
accggtaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaaccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaatttaaat

SEQ ID NO: 723 - DNA, 1586 bp, Artificial sequence
  Synthesized
accggtcagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaatttaaat

SEQ ID NO: 724 - DNA, 1705 bp, Artificial sequence
  Synthesized
ggcgcgcccagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaa

SEQ ID NO: 725 - DNA, 1572 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctg

SEQ ID NO: 726 - DNA, 1852 bp, Artificial sequence
  Synthesized
tttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtg

SEQ ID NO: 727 - DNA, 1575 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctg

SEQ ID NO: 728 - DNA, 2248 bp, Artificial sequence
  Synthesized
cagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctg

SEQ ID NO: 729 - DNA, 2555 bp, Artificial sequence
  Synthesized
ctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggaaggtgctctgagcggtggccccaagctagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagcttaattaaagaggaaacttgatctgtcgccgcaattcaaacttcgtgaggctccggtgcccgtcagtg

SEQ ID NO: 730 - DNA, 1519 bp, Artificial sequence
  Synthesized
ttaattaatcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgcc

SEQ ID NO: 731 - DNA, 2014 bp, Artificial sequence
  Synthesized
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 732 - DNA, 1762 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctg

SEQ ID NO: 733 - DNA, 2769 bp, Artificial sequence
  Synthesized
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcacaggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgag

SEQ ID NO: 734 - DNA, 1246 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactatcagcccttctgccaaatctggtagctatagttgatgttcgaggcgaagtcttgggtgaacaccggcctaaagttgctcgggatctcagggaagtacacatctccttcgggttcgatgtcgatggtggagatgtgcagagtgtccacttggtcgatcagtgacttgtagatttcgccccctccggacacaatgacatggtcggtgatcttcttgaggttcgtgagagcgtccttgatcgaagggaagatcagcacatcctcattgtcggaagtgaagctggatctggtcacgacggcgtatttccggttcggcagggcacccatggattcgaaagtcttgcgaccgacaagcaaccactggttgtaggtgatggccttgaacagcagctgctctccctttgcggaccagggaatatctgggccgttcccaatcactccgttctttgaaatcgccaccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtg

SEQ ID NO: 735 - DNA, 1780 bp, Artificial sequence
  Synthesized
cccacttctatgatccgcggccgcatgcatctcaattagtcagcaaccatagtcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctaggcttttgcaaaaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaaataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatcctgcctcgcgcgtttcggtgatgacggtgaaaacctcaaatcgataatatatggtagggttcatagccagagtaacctttttttttaatttttattttattttatttttgagtcgggcgcgccaaaatgaagtgaagttcctatactttctagatagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatac

SEQ ID NO: 736 - DNA, 1033 bp, Artificial sequence
  Synthesized
ttaattaacagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaggcgcgcc

SEQ ID NO: 737 - DNA, 1456 bp, Artificial sequence
  Synthesized
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatggttcgaccattgaactgcatcgtcgccgtgtcccaaaatatggggattggcaagaacggagatcttccctggcctccgctcaggaacgagttcaagtacttccaaagaatgaccacaacctcttcagtggaaggtaaacagaatctggtgattatgggtaggaaaacctggttctccattcctgagaagaatcgacctttaaaggacagaattaatatagttctcagtagagaactcaaagaaccaccacgaggagctcattttcttgccaaaagtttggatgatgccttaagacttattgaacaaccggaattggcaagtaaagtagacatggtttggatagtcggaggcagttctgtttaccaggaagccatgaatcaaccaggccacctcagactctttgtgacaaggatcatgcaggaatttgaaagtgacacgtttttcccagaaattgatttggggaaatataaacttctcccagaatacccaggcgtcctctctgaggtccaggaggaaaaaggcatcaagtataagtttgaagtctacgagaagaaagactaatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 738 - DNA, 1453 bp, Artificial sequence
  Synthesized
ggcgcgcctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcacacccaagctgtctagagccgccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaa

SEQ ID NO: 739 - DNA, 2059 bp, Artificial sequence
  Synthesized
ggcgcgccaagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtcaaaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaa

SEQ ID NO: 740 - DNA, 1114 bp, Artificial sequence
  Synthesized
ggcgcgcctcccgcccctaactccgcccagttccgcccattctccgccccatggctgactaattttttttatttatgcagaggccgaggccgcctcggcctctgagctattccagaagtagtgaggaggcttttttggaggtataggcttttgcaaaatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgatggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtaaaatcgataatatatggtagggttcatagccagagtaacctttttttttaatttttattttattttatttttgagtcgggcgcgcaaaaatgaagtgaagttcctatactttctagattaattaa

SEQ ID NO: 741 - DNA, 1333 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtg

SEQ ID NO: 742 - DNA, 1333 bp, Artificial sequence
  Synthesized
tttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtg

SEQ ID NO: 743 - DNA, 1492 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtaga

SEQ ID NO: 744 - DNA, 997 bp, Artificial sequence
  Synthesized
ggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcattttgcaaaagcctatacctccaaaaaagcctcctcactacttctggaatagctcagaggccgaggcggcctcggcctctgcataaataaaaaaaattagtcagccatggggcggagaatgggcggaactgggcggagttaggggcgggattaattaa

SEQ ID NO: 745 - DNA, 1069 bp, Artificial sequence
  Synthesized
ggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaa

SEQ ID NO: 746 - DNA, 1240 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctg

SEQ ID NO: 747 - DNA, 1995 bp, Artificial sequence
  Synthesized
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcacatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgatataggtaaggtatgggtggcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgag

SEQ ID NO: 748 - DNA, 1802 bp, Artificial sequence
  Synthesized
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgatataggtaaggtatgggtggcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggatctagcttcgtgtcaaggacggtgactgcagtgaataataaaatgtgtgtttgtccgaaatacgcgttttgagatttctcgag

SEQ ID NO: 749 - DNA, 2905 bp, Artificial sequence
  Synthesized
cactgacgggcaccggagcctcacgaagtttgaattgcggcgacagatcaagtttctctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcacacccaagctgtctagagccgccaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtgtcgcccgaccaccagggcaagggtctgggcagcgccgtcgtgctccccggagtggaggcggccgagcgcgccggggtgcccgccttcctggagacatccgcgccccgcaacctccccttctacgagcggctcggcttcaccgtcaccgccgacgtcgaggtgcccgaaggaccgcgcacctggtgcatgacccgcaagcccggtgcctgagaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaatatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagacaaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccgcatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggta

SEQ ID NO: 750 - protein, 610 aa, Bombyx mori
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFDVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELSANYNVSRNSKRWPMTLFYGVLNMAAINACIIYRANKNVTIKRTEFIRSLGLSMIYEHLHSRNKKKNIPTYLRQRIEKQLGEPSPRHVNVPGRYVRCQDCPYKKDRKTKHSCNACAKPICMEHAKFLCENCAELDSSL

SEQ ID NO: 751 - DNA, 4243 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagaagaactcgtcaagaaggcgatagaaggcgatgcgctgcgaatcgggagcggcgataccgtaaagcacgaggaagcggtcagcccattcgccgccaagttcctcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgttcctcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 752 - DNA, 2413 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcagatcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggacacgctgtcgaacttttcgatcagaaacttctcgacagacgtcgcggtgagttcaggctttttcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 753 - DNA, 4471 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagctattcctttgccctcggacgagtgctggggcgtcggtttccactatcggcgagtacttctacacagccatcggtccagacggccgcgcttctgcgggcgatttgtgtacgcccgacagtcccggctccggatcggacgattgcgtcgcatcgaccctgcgcccaagctgcatcatcgaaattgccgtcaaccaagctctgatagagttggtcaagaccaatgcggagcatatacgcccggagccgcggcgatcctgcaagctccggatgcctccgctcgaagtagcgcgtctgctgctccatacaagccaaccacggcctccagaagaagatgttggcgacctcgtattgggaatccccgaacatcgcctcgctccagtcaatgaccgctgttatgcggccattgtccgtcaggacattgttggagccgaaatccgcgtgcacgaggtgccggacttcggggcagtcctcggcccaaagcatcagctcatcgagagcctgcgcgacggacgcactgacggtgtcgtccatcacagtttgccagtgatacacatggggatcagcaatcgcgcatatgaaatcacgccatgtagtgtattgaccgattccttgcggtccgaatgggccgaacccgctcgtctggctaagatcggccgcagcgatcgcatccatggcctccgcgaccggctgcagaacagcgggcagttcggtttcaggcagatcttgcaacgtgacaccctgtgcacggcgggagatgcaataggtcaggctctcgctgaattccccaatgtcaagcacttccggaatcgggagcgcggccgatgcaaagtgccgataaacataacgatctttgtagaaaccatcggcgcagctatttacccgcaggacatatccacgccctcctacatcgaagctgaaagcacgagattcttcgccctccgagagctgcatcaggtcggacacgctgtcgaacttttcgatcagaaacttctcgacagacgtcgcggtgagttcaggctttttcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 754 - DNA, 1786 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 755 - DNA, 3844 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagccctcccacacataaccagagggcagcaattcacgaatcccaactgccgtcggctgtccatcactgtccttcactatggctttgatcccaggatgcagatcgagaagcacctgtcggcaccgtccgcaggggctcaagatgcccctgttctcatttccgatcgcgacgatacaagtcaggttgccagctgccgcagcagcagcagtgcccagcaccacgagttctgcacaaggtcccccagtaaaatgatatacattgacaccagtgaagatgcggccgtcgctagagagagctgcgctggcgacgctgtaatcttcagagatggggatgctgttgattgtagccgttgctctttcaatgagggtggattcttcttgagacaaaggcttggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 756 - DNA, 2525 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacggcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 757 - DNA, 1987 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 758 - DNA, 2863 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 759 - DNA, 2821 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 760 - DNA, 2475 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagactactctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 761 - DNA, 1844 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 762 - DNA, 2443 bp, Artificial sequence
  Synthesized
ccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgccacccataccttacctatatcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 763 - DNA, 1929 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacggtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccg

SEQ ID NO: 764 - DNA, 3053 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacggtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgaccttccccggctactgaagcgcatcggacccgctcggttctattgggaccacgcccatccgccatattggaacagccgccatattggtaacgccgccatcttgattgggaccaccgcccctattgggaccaccgcccaattgggaccaccgcccacccagcgacccaggcccagaggctacgtcaccaggacccccggctgcccagcgccccctcgaggacacacaatgtaagtagaccaaggccttttattggctgcggtgttaaggcaagctgcctgtctatccctatctatctactatccacctggctctctagctccatactgcgtacggtgtttgttagcttagggtgatagcaagtagaacgctggtgatggttgctctctatcagtttagcgctggtgatggtggcctccttctccatttcttatatatatatgctggtgatggtccctcttccatggccgcggtgtgcttcggtgccgggtaccgtaacgtggtacagaaaaaggcctgacacgtacgcttctctccctaggatgctatgtgtctgtagcaccggcggagcttgcgagctcgatgtccaagatagagtctccatgactgctcagattgtctcctgtgttcacacaccagatattacaagcgacggccgccatgataagtccaaaaatgagcagaatacagaatattgtactcagaggctgcagccatcttggtggcctgctgtggtgctcttttcccgtggaggactccgtcagttcctgcgtgttgttgctcgtactgcgaagatctctcttgccccgtcctgaaaacctaggccctgacagaaaaaagggagagttaggagagggcacagaggattctgtctgtgtcaagggggcttccatgttgtttctttacctgagatctcttccaccagttgttttttatcagcaactgacaggtagtatatcaaaatgagtgcactgatgattattagcactgtatactttagatatcttctggtttctgtggacatctgttgatgataaaaaattatatttttttag

SEQ ID NO: 765 - DNA, 2096 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaagacttctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 766 - DNA, 1593 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcattttgcaaaagcctatacctccaaaaaagcctcctcactacttctggaatagctcagaggccgaggcggcctcggcctctgcataaataaaaaaaattagtcagccatggggcggagaatgggcggaactgggcggagttaggggcgggattaattaagaagacttctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 767 - DNA, 1665 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 768 - DNA, 3119 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 769 - DNA, 2203 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 770 - DNA, 4045 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 771 - DNA, 3713 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgactacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtaaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcag

SEQ ID NO: 772 - DNA, 4053 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 773 - DNA, 4277 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 774 - DNA, 2749 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacggcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctctggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 775 - DNA, 3686 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 776 - DNA, 4269 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 777 - DNA, 4123 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgctgggaagggtccctaggattgtgcacctctcccgcgggggacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaag

SEQ ID NO: 778 - DNA, 4087 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaa

SEQ ID NO: 779 - DNA, 4133 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaa

SEQ ID NO: 780 - DNA, 3644 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacag

SEQ ID NO: 781 - DNA, 4157 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgttgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaagacttctctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 782 - DNA, 3734 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgttgtcttcggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 783 - DNA, 3776 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgttgtcttcggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaa

SEQ ID NO: 784 - DNA, 3822 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgttgtcttcggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaa

SEQ ID NO: 785 - DNA, 3219 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 786 - DNA, 2670 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 787 - DNA, 3341 bp, Artificial sequence
  Synthesized
ccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaatcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgccacccataccttacctatatcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 788 - DNA, 2994 bp, Artificial sequence
  Synthesized
tttctttatgttttaaatgcactgatctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagttagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagactactctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 789 - DNA, 2714 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 790 - DNA, 2176 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 791 - DNA, 3630 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 792 - DNA, 4570 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 793 - DNA, 4794 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 794 - DNA, 4485 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaattaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 795 - DNA, 4578 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 796 - DNA, 4612 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaa

SEQ ID NO: 797 - DNA, 4658 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaa

SEQ ID NO: 798 - DNA, 4527 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaattaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaa

SEQ ID NO: 799 - DNA, 4357 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaattaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacggggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcggactcttccgccgcagccgccgccatcgtcggcgcgcttccctgttcacctctgtatttgagaatccgacgccatctgccaccaggtgagtgtccgcggcgcggcaagacttggggactgtgacgagacttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggtgacctctagtgagctgagcctcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtcacagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacag

SEQ ID NO: 800 - DNA, 4573 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaattaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttctttttcgcaacgggtttgccgtcagaacgcaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaagccaccgctaattcaaagcaa

SEQ ID NO: 801 - DNA, 4578 bp, Artificial sequence; identical to SEQ ID NO: 795
  Synthesized

SEQ ID NO: 802 - DNA, 4913 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 803 - DNA, 5220 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgatgtcttcctcgagaaatctcaaaacgcgtatttcggacaaacacacattttattattcactgcagtcaccgtccttgacacgaagctagatccagacatgataagatacattgatgagtttggacaaaccacaactagaatgcagtgaaaaaaatgctttatttgtgaaatttgtgatgctattgctttatttgtaaccattataagctgcaataaacaagttaacaacaacaattgcattcattttatgtttcaggttcagggggaggtgtgggaggttttttaaagcaagtaaaacctctacaaatgtggtatggctgattatgatctctagtcaaggcactatacatcaaatattccttattaacccctttacaaattaaaaagctaaaggtacacaatttttgagcatagttattaatagcagacactctatgcctgtgtggagtaagaaaaaacagtatgttatgattataactgttatgcctacttataaaggttacagaatatttttccataattttcttgtatagcagtgcagctttttcctttgtggtgtaaatagcaaagcaagcaagagttctattactaaacacagcatgactcaaaaaacttagcaattctgaaggaaagtccttgggatcttctacctttctcttcttttttggaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaattagtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggaaggtgctctgagcggtggccccaagctagctttttgcaaaagcctaggcctccaaaaaagcctcctcactacttctggaatagctcagaggccgaggcggcctcggcctctgcataaataaaaaaaattagtcagccatggggcggagaatgggcggaactgggcggagttaggggcgggatgggcggagttaggggcgggactatggttgctgactaattgagatgcatgctttgcatacttctgcctgctggggagcctggggactttccacacctggttgctgactaattgagatgcatgctttgcatacttctgcctgctggggagcctggggactttccacaccctaactgacacacattccacagcttaattaaagaggaaacttgatctgtcgccgcaattcaaacttcgtgaggctccggtgcccgtcagtggaagacatctctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 804 - DNA, 4184 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgttgtcttcggcgcgcctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccattttgcaaaagcctatacctccaaaaaagcctcctcactacttctggaatagctcagaggccgaggcggcctcggcctctgcataaataaaaaaaattagtcagccatggggcggagaatgggcggaactgggcggagttaggggcgggattaattaagaagacttctctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 805 - DNA, 4679 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgttgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaagacttctctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 806 - DNA, 3192 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 807 - DNA, 3659 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaattaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtacctgtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 808 - DNA, 3744 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtaccggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgcggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacacgagtgccttaaatttgtctctgcaggcttccggttgtacttgaaaacttcacagaacaccagcttgttgggatctctgcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaagtacatttgcttgatgtttttgttcaagtgggaacttgctgaggtggccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 809 - DNA, 1629 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggaagatctccgttcttgccaatccccatattttgggacacggcgacgatgcagttcaatggtcgaaccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 810 - DNA, 2060 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggaagatctccgttcttgccaatccccatattttgggacacggcgacgatgcagttcaatggtcgaaccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaagacttctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccg

SEQ ID NO: 811 - DNA, 3011 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggaagatctccgttcttgccaatccccatattttgggacacggcgacgatgcagttcaatggtcgaaccattttgcaaaagcctatacctccaaaaaagcctcctcactacttctggaatagctcagaggccgaggcggcctcggcctctgcataaataaaaaaaattagtcagccatggggcggagaatgggcggaactgggcggagttaggggcgggattaattaagaagacttctctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 812 - DNA, 3083 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggaagatctccgttcttgccaatccccatattttgggacacggcgacgatgcagttcaatggtcgaaccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctgttaattaagaagacttctctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 813 - DNA, 3514 bp, Artificial sequence
  Synthesized
taccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggaagatctccgttcttgccaatccccatattttgggacacggcgacgatgcagttcaatggtcgaaccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaagacttctctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 814 - DNA, 4239 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 815 - DNA, 4015 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattctctgtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 816 - DNA, 5764 bp, Artificial sequence
  Synthesized
atgtgaagagcttatattccccagaacatcaggttaatggcgtttttgatgtcattttcgcggtggctgagatcagccacttcttccccgataacggaaaccggcacactggccatatcggtggtcatcatgcgccagctttcatccccgatatgcaccaccgggtaaagttcacgggagactttatctgacagcagacgtgcactggccagggggatcaccatccgtcgcccgggcgtgtcaataatatcactctgtacatccacaaacagacgataacggctctctcttttataggtgtaaaccttaaactgcatttcaccagcccctgttctcgtcagcaaaagagccgttcatttcaataaaccgggcgacctcagccatcccttcctgattttccgctttccagcgttcggcacgcagacgacgggcttcattctgcatggttgtgcttaccagaccggagatattgacatcatatatgccttgagcaactgatagctgtcgctgtcaactgtcactgtaatacgctgcttcatagcatacctctttttgacatacttcgggtatacatatcagtatatattcttataccgcaaaaatcagcgcgcaaatacgcatactgttatctggcttttagtaagccgacgcactttgcgccgagtttattcttgacacagatatttatgatataataactgagtaagcttaacataaggaggaaaaacatatgagggaagcggtgatcgccgaagtatcgactcaactatcagaggtagttggcgtcatcgagcgccatctcgaaccgacgttgctggccgtacatttgtacggctccgcagtggatggcggcctgaagccacacagtgatattgatttgctggttacggtgaccgtaaggcttgatgaaacaacgcggcgagctttgatcaacgaccttttggaaacttcggcttcccctggagagagcgaaatcctccgcgctgtagaagtcaccattgttgtgcacgacgacatcattccgtggcgttatccagctaagcgcgaactgcaatttggagaatggcagcgcaatgacattcttgcaggaatcttcgagccagccacgatcgacattgatctggctatcttgctgacaaaagcaagagaacatagcgttgccttggtaggtccagcggcggaggaactctttgatccggttcctgaacaggatctatttgaggcgctaaatgaaaccttaacgctatggaactcgccgcccgactgggctggcgatgagcgaaatgtagtgcttacgttgtcccgcatttggtacagcgcagtaaccggcaaaatcgcgccgaaggatgtcgctgccgactgggcaatggagcgcctgccggcccagtatcagcccgtcatacttgaagctagacaggcttatcttggacaagaagaagatcgcttggcctcgcgcgcagatcagttggaagaatttgtccactacgtgaaaggcgagatcaccaaggtagtcggcaaataagctcttcaggttgaggtctctaaaagcgagcaggtctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctcagtggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctcaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattcctaggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgag

SEQ ID NO: 817 - DNA, 4121 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtgttgtcttctaccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctgagcggatccattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggaagatctccgttcttgccaatccccatattttgggacacggcgacgatgcagttcaatggtcgaaccatgtgaagtgtcccagcctgtttatctacggcttaaaaagtgttcgaggggaaaataggttgcgcgagattatagagatctggcgcactaaaaaccagtatttcacatgagtccgcgtctttttacgcactgcctctccctgacgcgggataaagtggtattctcaaacatatctcgcaagcctgtcttgtgtccaagcttgacgaaaggcccggagatgaggaagaggagaacagcgcggcagacgtgcgcttttgaagcgtgcagaatgccgggcctccggaggaccttcgggcgcccgccccgcccctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaagacttctctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 818 - DNA, 4266 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccattttgctgtatttaatagtaaaatatactttagtgtgatgattgtggtgtgatccaatggcacaaatccaacaaaagagtaaataatcgctctattgctcaccggatggccaatccaatagctatatggcaacaatctctcaattgtcaccataagcagccagatttggaataaaaggaaacacggacacccaaagtagtcggttccgctgcggagttgcccgttacgacagactgcccactggttcgtgggtatctgctccacagttaggattatccgcattcaggggccggaggactactaactagctcaatagactcttcgcaccatgtctgtattagagcgtcctatgggtcaccccataggcaggccgccagcgcagccaccgccacggtcgcccgtgaggaatgcggtgactcatcgacctgatctacactggggaagtgctgagtgaaacactccgcaactttcatggtgttactaggtttttcgaagtagttagccggataacgaacgttttctccttcaaccgcgtgagcagtctattgatactcggtccggggaaacaggagtgcttgatctagacacggctggtgtgccacgcccactattgatcggtatgaattgcttctaagtttcagtagggggaggggtataaaacaggcacacaaaggtaccgtagtaccagagtgctagcgcccagtgggccctgtgggtgggtacaacccacaggctgttttaatcagaagaactcgtcaagaaggcgatagaaggcgatgcgctgcgaatcgggagcggcgataccgtaaagcacgaggaagcggtcagcccattcgccgccaagttcctcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgttcctcgtccagatcatcctgatcgacaagaccggcttccatccgagtacgtgctcgctcgatgcgatgtttcgcttggtggtcgaatgggcatgtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaaccagcgtgcaatccatcttgttcaatcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 819 - DNA, 4894 bp, Artificial sequence
  Synthesized
tttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcactattagtctttcttctcgtagacttcaaacttatacttgatgcctttttcctcctggacctcagagaggacgcctgggtattctgggagaagtttatatttccccaaatcaatttctgggaaaaacgtgtcactttcaaattcctgcatgatccttgtcacaaagagtctgaggtggcctggttgattcatggcttcctggtaaacagaactgcctccgactatccaaaccatgtctactttacttgccaattccggttgttcaataagtcttaaggcatcatccaaacttttggcaagaaaatgagctcctcgtggtggttctttgagttctctactgagaactatattaattctgtcctttaaaggtcgattcttctcaggaatggagaaccaggttttcctacccataatcaccagattctgtttaccttccactgaagaggttgtggtcattctttggaagtacttgaactcgttcctgagcggaggccagggcaagtctccgttcttgccaatccccatattttgggacacggcgacgatgcagttcaatggtcgaaccattttgctgtatttaatagtaaaatatactttagtgtgatgattgtggtgtgatccaatggcacaaatccaacaaaagagtaaataatcgctctattgctcaccggatggccaatccaatagctatatggcaacaatctctcaattgtcaccataagcagccagatttggaataaaaggaaacacggacacccaaagtagtcggttccgctgcggagttgcccgttacgacagactgcccactggttcgtgggtatctgctccacagttaggattatccgcattcaggggccggaggactactaactagctcaatagactcttcgcaccatgtctgtattagagcgtcctatgggtcaccccataggcaggccgccagcgcagccaccgccacggtcgcccgtgaggaatgcggtgactcatcgacctgatctacactggggaagtgctgagtgaaacactccgcaactttcatggtgttactaggtttttcgaagtagttagccggataacgaacgttttctccttcaaccgcgtgagcagtctattgatactcggtccggggaaacaggagtgcttgatctagacacggctggtgtgccacgcccactattgatcggtatgaattgcttctaagtttcagtagggggaggggtataaaacaggcacacaaaggtaccgtagtaccagagtgctagcgcccagtgggccctgtgggtgggtacaacccacaggctgttttaatcagaagaactcgtcaagaaggcgatagaaggcgatgcgctgcgaatcgggagcggcgataccgtaaagcacgaggaagcggtcagcccattcgccgccaagttcctcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgttcctcgtccagatcatcctgatcgacaagaccggcttccatccgagtacgtgctcgctcgatgcgatgtttcgcttggtggtcgaatgggcatgtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaaccagcgtgcaatccatcttgttcaatcatggtggcgacgtgcgctccggaggcttgcagaatgcggaacaccgcgcgggcaggaacagggcccacactaccgccccacaccccgcctcccgcaccgccccttcccggccgctgctctcagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagactactctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 820 - DNA, 3144 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatctcagtggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctcagaatattctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtatgaacatctacatggcaattctccagctgcctgtcccagtcctactgacccagctgtatctctccaggcaagcacttccaccccttctgcttgcatccagacaccatcaaacatgcaggctcagacacagggaccagcagtgtctgtggcctttttgtgctcctctccatgctgggttttaacttgctctttgtccttctatcctatcttcttatccttaaggctgttctgaacgctgtgacttggagagtgtcccagagccctcaacaccagcatgtcccacgtccatgctgtcctgcacttccttatccccaagatctgcctctccgtgatgcactgaattggcaaacatgtgtcaccccagaccaacaatgtcacagcaaactcccccttgataggacaagggggaatggctttacactgagacaggggaggtttgggttggatatgaggaggcagtttttcccccagagggtggtgacgcactgaacaggttgcccaaggaggctgtggatgccccatccctgcaggcattcaaggccaggctggatgtggctctgggcagcctgggctgctggttgatgaccctgcacatagcagggggttggatctggatgagcactgtgctcctttgcaacccaggccgttctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcgc

SEQ ID NO: 821 - DNA, 3144 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctcagtggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctcagaatattctcactgactccgtcctggagttggatgagagataatggccttacgttgtgccaggggagggtcgggctggatttagcaagatttaccttctccaaagagcggtgctgcagtggcacagctgcccacggaggtgggggggtcaccgtccctggaggtgatgaagaactgtggggatgtggcactgagggacatggccagtgggcacggtgggtgggttggggttggtcttggggatcttggagggcttttccagccttcatgatttgacgattgtatgaacatctacatggcaattctccagctgcctgtcccagtcctactgacccagctgtatctctccaggcaagcacttccaccccttctgcttgcatccagacaccatcaaacatgcaggctcagacacagggaccagcagtgtctgtggcctttttgtgctcctctccatgctgggttttaacttgctctttgtccttctatcctatcttcttatccttaaggctgttctgaacgctgtgacttggagagtgtcccagagccctcaacaccagcatgtcccacgtccatgctgtcctgcacttccttatccccaagatctgcctctccgtgatgcactgaattggcaaacatgtgtcaccccagaccaacaatgtcacagcaaactcccccttgataggacaagggggaatggctttacactgagacaggggaggtttgggttggatatgaggaggcagtttttcccccagagggtggtgacgcactgaacaggttgcccaaggaggctgtggatgccccatccctgcaggcattcaaggccaggctggatgtggctctgggcagcctgggctgctggttgatgaccctgcacatagcagggggttggatctggatgagcactgtgctcctttgcaacccaggccgttctatgattctgtcattctaaatctctctttcagcctaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcgc

SEQ ID NO: 822 - DNA, 1711 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaaggagtgtggaactgaacctccgtgggagtcttgagtgtgccaggccctctctccgtgaaggaggcaatgcctgtgggcgtcgccgttgccgggacggtctggcacacgcaggcgtgtggctctcgttcatttccacgtagaagtccagagcgacaccccagagaggagatgcctccccggcgtgatggcctgacgatggattcccgcgtgcggcaacgtggggagtctgcagtgtggccggtttggaacctggcaaggagagcgaaggcaccgtgccgggcttgcacccttccctgcatgtttccgggtgcccgcagagctccgggagcaaacagtcggcatggccagcctttcgggggccggagagacttgagcaacaggccgccttgcggagggcaaagccacgcggaaaccaaaatcacgcctccgtcgtcctgcgtgtggctcctccgtggccggggctgtcggcctcgcgccgcgttgcagggctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcctggaacgctcagcgtccccggtgtgcgccgggcctggggtctgcgttccgccgccaggcgctccgtgctggcacctgggcggctgcaggggcccgggcgggcgggcgacggtggcgcgggggcgcataggaggcgagccgccggagcggtgtcaggcccggacgctgcgcggggcccggtgtttcgcgggacgggggtcaccacccagcccaggggacgacgcgttttccgggggtggggggtggggggtggggagggggcggtcaggcggcggggtgggctggtggagaggcaggagagctctgcccgggctgctcccacagcccaggcggctgcccgcaaacccgcgcgtgcgcagtaggcggcccacctggtg

SEQ ID NO: 823 - DNA, 645 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcgc

SEQ ID NO: 824 - DNA, 2521 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaaggagtgtggaactgaacctccgtgggagtcttgagtgtgccaggccctctctccgtgaaggaggcaatgcctgtgggcgtcgccgttgccgggacggtctggcacacgcaggcgtgtggctctcgttcatttccacgtagaagtccagagcgacaccccagagaggagatgcctccccggcgtgatggcctgacgatggattcccgcgtgcggcaacgtggggagtctgcagtgtggccggtttggaacctggcaaggagagcgaaggcaccgtgccgggcttgcacccttccctgcatgtttccgggtgcccgcagagctccgggagcaaacagtcggcatggccagcctttcgggggccggagagacttgagcaacaggccgccttgcggagggcaaagccacgcggaaaccaaaatcacgcctccgtcgtcctgcgtgtggctcctccgtggccggggctgtcggcctcgcgccgcgttgcagggctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcctggaacgctcagcgtccccggtgtgcgccgggcctggggtctgcgttccgccgccaggcgctccgtgctggcacctgggcggctgcaggggcccgggcgggcgggcgacggtggcgcgggggcgcataggaggcgagccgccggagcggtgtcaggcccggacgctgcgcggggcccggtgtttcgcgggacgggggtcaccacccagcccaggggacgacgcgttttccgggggtggggggtggggggtggggagggggcggtcaggcggcggggtgggctggtggagaggcaggagagctctgcccgggctgctcccacagcccaggcggctgcccgcaaacccgcgcgtgcgcagtaggcggcccacctggtg

SEQ ID NO: 825 - DNA, 3247 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaaggagtgtggaactgaacctccgtgggagtcttgagtgtgccaggccctctctccgtgaaggaggcaatgcctgtgggcgtcgccgttgccgggacggtctggcacacgcaggcgtgtggctctcgttcatttccacgtagaagtccagagcgacaccccagagaggagatgcctccccggcgtgatggcctgacgatggattcccgcgtgcggcaacgtggggagtctgcagtgtggccggtttggaacctggcaaggagagcgaaggcaccgtgccgggcttgcacccttccctgcatgtttccgggtgcccgcagagctccgggagcaaacagtcggcatggccagcctttcgggggccggagagacttgagcaacaggccgccttgcggagggcaaagccacgcggaaaccaaaatcacgcctccgtcgtcctgcgtgtggctcctccgtggccggggctgtcggcctcgcgccgcgttgcagggctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcctggaacgctcagcgtccccggtgtgcgccgggcctggggtctgcgttccgccgccaggcgctccgtgctggcacctgggcggctgcaggggcccgggcgggcgggcgacggtggcgcgggggcgcataggaggcgagccgccggagcggtgtcaggcccggacgctgcgcggggcccggtgtttcgcgggacgggggtcaccacccagcccaggggacgacgcgttttccgggggtggggggtggggggtggggagggggcggtcaggcggcggggtgggctggtggagaggcaggagagctctgcccgggctgctcccacagcccaggcggctgcccgcaaacccgcgcgtgcgcagtaggcggcccacctggtg

SEQ ID NO: 826 - DNA, 2437 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaaggagtgtggaactgaacctccgtgggagtcttgagtgtgccaggccctctctccgtgaaggaggcaatgcctgtgggcgtcgccgttgccgggacggtctggcacacgcaggcgtgtggctctcgttcatttccacgtagaagtccagagcgacaccccagagaggagatgcctccccggcgtgatggcctgacgatggattcccgcgtgcggcaacgtggggagtctgcagtgtggccggtttggaacctggcaaggagagcgaaggcaccgtgccgggcttgcacccttccctgcatgtttccgggtgcccgcagagctccgggagcaaacagtcggcatggccagcctttcgggggccggagagacttgagcaacaggccgccttgcggagggcaaagccacgcggaaaccaaaatcacgcctccgtcgtcctgcgtgtggctcctccgtggccggggctgtcggcctcgcgccgcgttgcagggctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcctggaacgctcagcgtccccggtgtgcgccgggcctggggtctgcgttccgccgccaggcgctccgtgctggcacctgggcggctgcaggggcccgggcgggcgggcgacggtggcgcgggggcgcataggaggcgagccgccggagcggtgtcaggcccggacgctgcgcggggcccggtgtttcgcgggacgggggtcaccacccagcccaggggacgacgcgttttccgggggtggggggtggggggtggggagggggcggtcaggcggcggggtgggctggtggagaggcaggagagctctgcccgggctgctcccacagcccaggcggctgcccgcaaacccgcgcgtgcgcagtaggcggcccacctggtg

SEQ ID NO: 827 - DNA, 2181 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcgc

SEQ ID NO: 828 - DNA, 1371 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcgc

SEQ ID NO: 829 - DNA, 1455 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagaaagctttttccccgtatccccccaggtgtctgcaggctcaaagagcagcgagaagcgttcagaggaaagcgatcccgtgccaccttccccgtgcccgggctgtccccgcacgctgccggctcggggatgcggggggagcgccggaccggagcggagccccgggcggctcgctgctgccccctagcgggggagggacgtaattacatccctgggggctttgggggggggctgtccccgtgagctcgc

SEQ ID NO: 830 - DNA, 2414 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcc

SEQ ID NO: 831 - DNA, 1604 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcc

SEQ ID NO: 832 - DNA, 1688 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcc

SEQ ID NO: 833 - DNA, 878 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgctcagcctggggatgtgcggtctgtgaaccgcgcgggtgaacacccgacggcaacccgagtcccggtcttttgtcccggaggaaaccgcccactccctgggccacggaaccggggcgaatgggtggtgccccgccggccggcgcggcggctgtgggcccagccctcagcccgcgccggacgctgaccgttttcccggagggcgggggtcccgctactcccggaggccgaggaccgcttttcctccctgccttcctccccccgttccccggctccctcccgcccgcccccagtccctgcgtcgctctgtctttccctccgttcctccctgcctccctgcctccctccctccctcctaacgtccctccgcccgtccttccgcccctctaggactcccgttcctctctccatctctgcccgccttccctcccgcc

SEQ ID NO: 834 - DNA, 510 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcctccctccgttcctccctgcctccctgcctccctgcctccctcctaacgtcccttccgcccctct

SEQ ID NO: 835 - DNA, 1320 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcctccctccgttcctccctgcctccctgcctccctgcctccctcctaacgtcccttccgcccctct

SEQ ID NO: 836 - DNA, 1236 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcctccctccgttcctccctgcctccctgcctccctgcctccctcctaacgtcccttccgcccctct

SEQ ID NO: 837 - DNA, 1601 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaaatcatcgtcctttccttggctgctcgcctgtgttgccacctggattctgcgcgggacgtccttctgctacgtcccttcggccctcaatccagcggaccttccttcccgcggcctgctgccggctctgcggcctcttccgcctcttcgccttcgccctcagacgagtcggatctccctttgggccgcctccccgcatctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattggcaagacaatagcaggc

SEQ ID NO: 838 - DNA, 1733 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattggcaagacaatagcaggc

SEQ ID NO: 839 - DNA, 3144 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatctcagtggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctcaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatatt

SEQ ID NO: 840 - DNA, 3144 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctcagtggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatctcaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatatt

SEQ ID NO: 841 - DNA, 1711 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactcc

SEQ ID NO: 842 - DNA, 645 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctt

SEQ ID NO: 843 - DNA, 1923 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 844 - DNA, 1113 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 845 - DNA, 1197 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 846 - DNA, 2521 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactcc

SEQ ID NO: 847 - DNA, 3247 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactcc

SEQ ID NO: 848 - DNA, 2437 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactcc

SEQ ID NO: 849 - DNA, 2181 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctt

SEQ ID NO: 850 - DNA, 1371 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctt

SEQ ID NO: 851 - DNA, 1455 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaatctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctt

SEQ ID NO: 852 - DNA, 2414 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagc

SEQ ID NO: 853 - DNA, 1604 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagc

SEQ ID NO: 854 - DNA, 1688 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagc

SEQ ID NO: 855 - DNA, 878 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagc

SEQ ID NO: 856 - DNA, 510 bp, Artificial sequence
  Synthesized
tggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcagaggggcggaagggacgttaggagggaggcagggaggcagggaggcagggaggaacggagggag

SEQ ID NO: 857 - DNA, 1320 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcagaggggcggaagggacgttaggagggaggcagggaggcagggaggcagggaggaacggagggag

SEQ ID NO: 858 - DNA, 1236 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatctggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcagaggggcggaagggacgttaggagggaggcagggaggcagggaggcagggaggaacggagggag

SEQ ID NO: 859 - DNA, 1296 bp, Artificial sequence
  Synthesized
cagcaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggagacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagacctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtcttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcacgtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtctcgctctggtcttctacgtggaaatgaacgagagccacacgcctgcgtgtgcgagaccgtcccggcaacggcgacgcccacaggcattgcctccttcacggagagagggcctggcacactcaagactcccacggaggttcagttccacactcc

SEQ ID NO: 860 - DNA, 1296 bp, Artificial sequence
  Synthesized
caccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactcc

SEQ ID NO: 861 - DNA, 433 bp, Artificial sequence
  Synthesized
ggcgggagggaaggcgggcagagatggagagaggaacgggagacctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtcttcacccgcgcggttcacagaccgcacatccccaggctgagc

SEQ ID NO: 862 - DNA, 433 bp, Artificial sequence
  Synthesized
ggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagc

SEQ ID NO: 863 - DNA, 65 bp, Artificial sequence
  Synthesized
agaggggcggaagggacgttaggagggaggcagggaggcagggaggcagggaggaacggagggag

SEQ ID NO: 864 - DNA, 1213 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatatt

SEQ ID NO: 865 - DNA, 246 bp, Artificial sequence
  Synthesized
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctt

SEQ ID NO: 866 - DNA, 1536 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatc

SEQ ID NO: 867 - DNA, 726 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatc

SEQ ID NO: 868 - DNA, 726 bp, Artificial sequence
  Synthesized
ataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatc

SEQ ID NO: 869 - DNA, 810 bp, Artificial sequence
  Synthesized
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagtta

SEQ ID NO: 870 - DNA, 155 bp, Artificial sequence
  Synthesized
ggcatgcttctatattattttctaaaagatttaaagttttgccttctccatttagacttataattcactggaatttttttgtgtgtatggtatgacatatgggttcccttttattttttacatataaatatatttccctgtttttctaaaaaaga

SEQ ID NO: 871 - DNA, 300 bp, Artificial sequence
  Synthesized
ggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagtta

SEQ ID NO: 872 - DNA, 1454 bp, Artificial sequence
  Synthesized
aagctttagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatcaaactctatccttctgtctccacctctcaggttctggggttcctggcatgcagcacccaagcccagctacctctgtgaaaactataacttagtaatcagatcctggaccatttaaagaatatatatatatgtatgtgtgtgtgtgtgtatatatataatatatacatatgtatgtatatatacatatatatgtatgtgtatatatgtatgtatagagaggctgactatatatatatatatatatatgaggctgaatatatatatatatatgaatacacatacacatagtgccatggcacattcctttaatctgagctctcaggcaaaggcagaccaatctctgagttgttcaaggccagtgtgatccatagtctcagaaattatatactgagacactcctgaggatgttatcacatttctagtttccttatcttactttaggacatgattccaaaaaaaaggggggggggacacacagtcaatggtagagttacaagactatgccgatgtggtgactcaagaagagagggctgagggagctgaaacaggcatgttcccatgaattccgggcaagcctaggctatagagtgagaccaccatgatttaaaaaaaaaaaaaaagtggcacgcgagaaagtcaacaatgctttgcataagtgttttacctcaaaatcgctgaatagttgactagaacaaattaaaaccttgtccaaagtcaaggccagtgggatcagggactccctccagtcctgaagctt

SEQ ID NO: 873 - DNA, 1260 bp, Artificial sequence
  Synthesized
tagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatcaaactctatccttctgtctccacctctcaggttctggggttcctggcatgcagcacccaagcccagctacctctgtgaaaactataacttagtaatcagatcctggaccatttaaagaatatatatatatgtatgtgtgtgtgtgtgtatatatataatatatacatatgtatgtatatatacatatatatgtatgtgtatatatgtatgtatagagaggctgactatatatatatatatatatatgaggctgaatatatatatatatatgaatacacatacacatagtgccatggcacattcctttaatctgagctctcaggcaaaggcagaccaatctctgagttgttcaaggccagtgtgatccatagtctcagaaattatatactgagacactcctgaggatgttatcacatttctagtttccttatcttactttaggacatgattccaaaaaaaaggggggggggacacacagtcaatggtagagttacaagactatgccgatgtggtgactcaagaagagagggctgagggagctgaaacaggcatgttcccatgaattccgg

SEQ ID NO: 874 - DNA, 404 bp, Artificial sequence
  Synthesized
tagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatac

SEQ ID NO: 875 - DNA, 691 bp, Artificial sequence
  Synthesized
tagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatc

SEQ ID NO: 876 - DNA, 1454 bp, Artificial sequence
  Synthesized
aagctttagactctgggtagaatgttctgtttcctgtaatataaaatcataaagtgatgatattatcaagtgaaaaggaaatgtggtaccttaatctttccacatcaagccaatatcatgctgaaggccagagaatcttttttgctaaaaaacacaatacagatataattaatagttatcatttatgtttgatattaatcatatgaatataattaatatgttttattgtatcgattattgttgatattaatgtaattactactaatacataacaaatataactaatggttatggctcagtaactaaggtaagatataagctacactggtaaagaaagatcaatattgcttcagagtacactgaagtaaatgaataacttaaccggtctaggttgtcacttatatttatacaacattttaagaactaagaacctctcttctatgcttagtagatgaacaaaatcatgtaatagatgaatgaggccaggaagtacaaaggtttacaaaattgccaagccactctggggtgattttatgagtaatgcggcatttggtagcttgccttaaagaatattattggacattatcaagtgtgtgtgtgtgtgtgtgtgtgtgtgtgtgtgtgtgtaactgaactctcttgtagtttcatttttgtttgaaaaagacatgtatctcatgtagcccaggctggaatcaaactctatccttctgtctccacctctcaggttctggggttcctggcatgcagcacccaagcccagctacctctgtgaaaactataacttagtaatcagatcctggaccatttaaagaatatatatatatgtatgtgtgtgtgtgtgtatatatataatatatacatatgtatgtatatatacatatatatgtatgtgtatatatgtatgtatagagaggctgactatatatatatatatatatatgaggctgaatatatatatatatatgaatacacatacacatagtgccatggcacattcctttaatctgagctctcaggcaaaggcagaccaatctctgagttgttcaaggccagtgtgatccatagtctcagaaattatatactgagacactcctgaggatgttatcacatttctagtttccttatcttactttaggacatgattccaaaaaaaaggggggggggacacacagtcaatggtagagttacaagactatgccgatgtggtgactcaagaagagagggctgagggagctgaaacaggcatgttcccatgaattccgggcaagcctaggctatagagtcagaccaccatgatttaaaaaaaaaaaaaaagtggcacgcgagaaagtcaacaatgctttgcataagtgttttacctcaaaatcgctgaatagttgactagaacaaattaaaaccttgtccaaagtcaaggccagtgggatcagggactccctccagtcctgaagctt

SEQ ID NO: 877 - DNA, 293 bp, Artificial sequence
  Synthesized
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattacca

SEQ ID NO: 878 - DNA, 364 bp, Artificial sequence
  Synthesized
actagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 879 - DNA, 375 bp, Artificial sequence
  Synthesized
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 880 - DNA, 375 bp, Artificial sequence
  Synthesized
attgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattacca

SEQ ID NO: 881 - DNA, 374 bp, Artificial sequence
  Synthesized
attgattattgagtagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacggttagtcatcgctattacca

SEQ ID NO: 882 - DNA, 305 bp, Artificial sequence
  Synthesized
ccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 883 - DNA, 275 bp, Artificial sequence
  Synthesized
acttacggtaaatggcccgcctggctgaccgcccaacgacccccgcccattgacgtcaatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattgtgcccagtacatgaccttatgggactttcctacttggcagtacatctacgtattagtcatcgctattacca

SEQ ID NO: 884 - DNA, 293 bp, Artificial sequence
  Synthesized
acttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 885 - DNA, 292 bp, Artificial sequence
  Synthesized
actacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 886 - DNA, 293 bp, Artificial sequence
  Synthesized
acttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattacca

SEQ ID NO: 887 - DNA, 412 bp, Artificial sequence
  Synthesized
gtcagtgtacttggctccaatgggtttttcccattgactcatcccctattgaccttatgtactgggcaaaacccaatggaaagtccctattgacgcagtgtacttggctccaatgggactttcctgttgattcaccccctattgaccttatgtactgggcagaatacaatggaaagtccctattgactcacccacattgaccttatatgcttgccaacaatggaaaaacccattggaaagtccctattgagtcagtgtacttggcagcaatgggtttttcccattggctcacctcccattgacccaatgtacttgggcaaaacccagtggaaagtcccatttgactcagtgtgcttgccagtaatgggaaaaacccattggcttacctcccattgacccaatgtacttgggt

SEQ ID NO: 888 - DNA, 294 bp, Artificial sequence
  Synthesized
tgagtcaatagggactttccaatgggttttgcccagtacataaggtcaatgggaggtaagccaatgggtttttcccattactggcacgtatactgagtcattagggactttccaatgggttttgcccagtacataaggtcaataggggtgaatcaacaggaaagttccattggagccaagtacactgagtcaatagggactttccattgggttttgcccagtacaaaaggtcaatagggggtgagtcaatgggtttttcccattattggcacgtacataaggtcaataggggtg

SEQ ID NO: 889 - DNA, 423 bp, Artificial sequence
  Synthesized
gagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtg

SEQ ID NO: 890 - DNA, 102 bp, Artificial sequence
  Synthesized
ccagctgttggggtgagtactccctctcaaaagcgggcattacttctgcgctaagattgtcagtttccaaaaacgaggaggatttgatattcacctggcccg

SEQ ID NO: 891 - DNA, 144 bp, Simian virus 40
ggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaacca

SEQ ID NO: 892 - DNA, 178 bp, Artificial sequence
  Synthesized
gcacatcgcccacagtccccgagaagttggggggaggctctggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 893 - DNA, 369 bp, Artificial sequence
  Synthesized
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 894 - DNA, 369 bp, Artificial sequence
  Synthesized
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 895 - DNA, 372 bp, Artificial sequence
  Synthesized
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 896 - DNA, 372 bp, Artificial sequence
  Synthesized
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 897 - DNA, 372 bp, Artificial sequence
  Synthesized
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 898 - DNA, 570 bp, Artificial sequence
  Synthesized
ctgggctgagacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 899 - DNA, 168 bp, Artificial sequence
  Synthesized
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 900 - DNA, 171 bp, Artificial sequence
  Synthesized
gcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 901 - DNA, 171 bp, Artificial sequence
  Synthesized
gcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 902 - DNA, 168 bp, Artificial sequence
  Synthesized
gcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 903 - DNA, 171 bp, Artificial sequence
  Synthesized
gcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 904 - DNA, 440 bp, Artificial sequence
  Synthesized
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 905 - DNA, 480 bp, Artificial sequence
  Synthesized
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttc

SEQ ID NO: 906 - DNA, 316 bp, Artificial sequence
  Synthesized
ggagccgagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgtt

SEQ ID NO: 907 - DNA, 503 bp, Artificial sequence
  Synthesized
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 908 - DNA, 503 bp, Artificial sequence
  Synthesized
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcttcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 909 - DNA, 301 bp, Artificial sequence
  Synthesized
ggagccgagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 910 - DNA, 459 bp, Artificial sequence
  Synthesized
ggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgtt

SEQ ID NO: 911 - DNA, 220 bp, Artificial sequence
  Synthesized
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 912 - DNA, 220 bp, Artificial sequence
  Synthesized
tgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 913 - DNA, 220 bp, Artificial sequence
  Synthesized
tagtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 914 - DNA, 220 bp, Artificial sequence
  Synthesized
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgcgtttagtgaaccg

SEQ ID NO: 915 - DNA, 220 bp, Artificial sequence
  Synthesized
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 916 - DNA, 314 bp, Artificial sequence
  Synthesized
agtcattgggtttttccagccatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcactcattctattggctgagctgcgttctacgtgggtataagaggcgcgaccagcgtcggtaccgtcgcagtcttcggtctgaccaccgtag

SEQ ID NO: 917 - DNA, 313 bp, Artificial sequence
  Synthesized
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtag

SEQ ID NO: 918 - DNA, 315 bp, Artificial sequence
  Synthesized
agtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtag

SEQ ID NO: 919 - DNA, 283 bp, Artificial sequence
  Synthesized
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggta

SEQ ID NO: 920 - DNA, 293 bp, Artificial sequence
  Synthesized
aaaggccattgagtcaccacccctatgctgggaaatggtgaacgccccctatgtggaaagtccctatgggccgccattagagtgcatgaccgtgctgattcatatgccatatgagtgtattagggggctttccgcgtgggaaattgggtaaaaagtccccgtattactcacatagggggcgtttggctttgcaaattaggggatttcagtgcatttggcattaaaaactattggttctagtcataaaacgggcggagttaaccatataattgctgtcccccatgccattcgag

SEQ ID NO: 921 - DNA, 783 bp, Artificial sequence
  Synthesized
tattaatagcaatcttagctaattaaaatagatagcgtttattgagcgttgggtatcaggcacggtcctaattcttttagatgtctttagttcgtttcactctcccccaaacaatagggtggtattgatcacctccgagcaggtgaaattgaggcacagagaaatcctagtagctggtagaagaacacgcagtgtggtcaagctagcaaggtgtttggtccactgctatatctacaaaacccctaacaatgcctggtgtatagatgctcagtatgcatttgtgggatcagtgattccgatgcctgcttcttataaagtttttatttagaaataattacaggtaaggagttgcaaaaacagtatagtgggatcgagtgtcctttttccctcggcttctcccaggggtatcgtcttacgtaacaatgtccaaacagggaaattgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 922 - DNA, 335 bp, Artificial sequence
  Synthesized
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgcaggttctcgcacgcgcacatcatcccgcaggcgagccccagcacccagcccagggtgcgcgcgcgccgtcacgtgacacgcccaaccggcgtcgccgtataaaagcgcgggcgttgacgtcagcggt

SEQ ID NO: 923 - DNA, 335 bp, Artificial sequence
  Synthesized
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgctggttctcgcacgcgcacatcatcccgcaggcgagccccagcacccagcccagggtgcgcgcgcgccgtcacgtgacacgcccaaccggcgtcgccgtataaaagcgcgggcgttgacgtcagcgtt

SEQ ID NO: 924 - DNA, 343 bp, Artificial sequence
  Synthesized
tgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 925 - DNA, 329 bp, Artificial sequence
  Synthesized
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcggt

SEQ ID NO: 926 - DNA, 329 bp, Artificial sequence
  Synthesized
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcgtt

SEQ ID NO: 927 - DNA, 325 bp, Artificial sequence
  Synthesized
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgg

SEQ ID NO: 928 - DNA, 326 bp, Artificial sequence
  Synthesized
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgtt

SEQ ID NO: 929 - DNA, 280 bp, Artificial sequence
  Synthesized
tggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 930 - DNA, 282 bp, Artificial sequence
  Synthesized
tggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 931 - DNA, 280 bp, Artificial sequence
  Synthesized
tggtcgaggtgagccccacgttctgcttcactctccccatctcccccccctccccacccccaattttgtatttatttattttttaattattttgtgcagcgatgggggcggggggggggggggcgcgcgccaggtggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 932 - DNA, 283 bp, Artificial sequence
  Synthesized
tgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcggga

SEQ ID NO: 933 - DNA, 270 bp, Artificial sequence
  Synthesized
tctctctttttttttttttttttttttttttttccaaaaggaggggagagggggtaaaaaaatgctgcactgtgcggctaggccggtgagtgagcggcgcggagccaatcagcgctcgccgttccgaaagttgccttttatggctcgagtggccgctgtggcgtcctataaaacccggcggcgcaacgcgcagccactgtcgagtccgcgtccacccgcgagcacaggcctttcgcagctctttcttcgccgctccacacccgccaccag

SEQ ID NO: 934 - DNA, 294 bp, Artificial sequence
  Synthesized
tcaatctcgctttctctctcgctttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtcgcgtccacccgcgagcacagcttctttgcagctccttcgttgccggtccacacccgccaccag

SEQ ID NO: 935 - DNA, 308 bp, Artificial sequence
  Synthesized
acctcttcctcaactcacttctctctactctcacttttttttttcttcttcttttttttttttttttttttttttttttttgcaaaagaagggggtaaaaaaatgctgcactgtcgggcgaggccggtgagtgagcgagccggagccaatcagcgcccgccgttccgaaattgccttttatggctcgagtggccgctgtggcgtcctataaaacccggcggcgcaacgcgcgccactgtcgagtccgcgtccacccgcgagtacaacctccttgcagctcctccgtcccggtccacacccgccaccag

SEQ ID NO: 936 - DNA, 523 bp, Artificial sequence
  Synthesized
atgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcag

SEQ ID NO: 937 - DNA, 508 bp, Artificial sequence
  Synthesized
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 938 - DNA, 460 bp, Artificial sequence
  Synthesized
ctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 939 - DNA, 466 bp, Artificial sequence
  Synthesized
cggggttggggttgcgccttttccaaggcagccctgggtttgcgcagggacgcggctgctctgggcgtggttccgggaaacgcagcggcgccgaccctgggcctcgcacattcttcacgtccgttcgcagcgtcacccggatcttcgccgctacccttgtgggccccccggcgacgcttcctcgtccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtc

SEQ ID NO: 940 - DNA, 458 bp, Artificial sequence
  Synthesized
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgagagcagcggccgggaaggggcggtgcgggaggcggggtgtggggcggtagtgtgggccctgttcctgcccgcgcggtgttccgcattctgcaagcctccggagcgcacgtc

SEQ ID NO: 941 - DNA, 1092 bp, Artificial sequence
  Synthesized
aagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtca

SEQ ID NO: 942 - DNA, 215 bp, Artificial sequence
  Synthesized
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcag

SEQ ID NO: 943 - DNA, 753 bp, Artificial sequence
  Synthesized
aaatgagtcttcggacctcgcgggggccgcttaagcggtggttagggtttgtctgacgcggggggagggggaaggaacgaaacactctcattcggaggcggctcggggtttggtcttggtggccacgggcacgcagaagagcgccgcgatcctcttaagcacccccccgccctccgtggaggcgggggtttggtcggcgggtggtaactggcgggccgctgactcgggcgggtcgcgcgccccagagtgtgaccttttcggtctgctcgcagacccccgggcggcgccgccgcggcggcgacgggctcgctgggtcctaggctccatggggaccgtatacgtggacaggctctggagcatccgcacgactgcggtgatattaccggagaccttctgcgggacgagccgggtcacgcggctgacgcggagcgtccgttgggcgacaaacaccaggacggggcacaggtacactatcttgtcacccggaggcgcgagggactgcaggagcttcagggagtggcgcagctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagcgacccgcttaa

SEQ ID NO: 944 - DNA, 270 bp, Artificial sequence
  Synthesized
cagtgtggttttcaagaggaagcaaaaagcctctccacccaggcctggaatgtttccacccaatgtcgagcagtgtggttttgcaagaggaagcaaaaagcctctccacccaggcctggaatgtttccacccaatgtcgagcaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagg

SEQ ID NO: 945 - DNA, 149 bp, Artificial sequence
  Synthesized
tcccgcccctaactccgcccagttccgcccattctccgccccatggctgactaattttttttatttatgcagaggccgaggccgcctcggcctctgagctattccagaagtagtgaggaggcttttttggaggtataggcttttgcaaa

SEQ ID NO: 946 - DNA, 128 bp, Artificial sequence
  Synthesized
gttccgcccattctccgccccatggctgactaattttttttatttatgcagaggccgaggccgcctcggcctctgagctattccagaagtagtgaggaggcttttttggaggcctaggcttttgcaaa

SEQ ID NO: 947 - DNA, 660 bp, Artificial sequence
  Synthesized
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 948 - DNA, 408 bp, Artificial sequence
  Synthesized
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 949 - DNA, 486 bp, Artificial sequence
  Synthesized
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacatctcttcccttctctctccttccaccgcccgttaccgtccctaggaaattttactctgctggagagcttcttctacggcccccttgcagcaatgcacttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 950 - DNA, 486 bp, Artificial sequence
  Synthesized
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 951 - DNA, 486 bp, Artificial sequence
  Synthesized
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctctacccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 952 - DNA, 931 bp, Artificial sequence
  Synthesized
aacatccaaagacgaaaggttgaatgaaacctttttgccatccgacatccacaggtccattctcacacataagtgccaaacgcaacaggaggggatacactagcagcagaccgttgcaaacgcaggacctccactcctcttctcctcaacacccacttttgccatcgaaaaaccagcccagttattgggcttgattggagctcgctcattccaattccttctattaggctactaacaccatgactttattagcctgtctatcctggcccccctggcgaggttcatgtttgtttatttccgaatgcaacaagctccgcattacacccgaacatcactccagatgagggctttctgagtgtggggtcaaatagtttcatgttccccaaatggcccaaaactgacagtttaaacgctgtcttggaacctaatatgacaaaagcgtgatctcatccaagatgaactaagtttggttcgttgaaatgctaacggccagttggtcaaaaagaaacttccaaaagtcggcataccgtttgtcttgtttggtattgattgacgaatgctcaaaaataatctcattaatgcttagcgcagtctctctatcgcttctgaaccccggtgcacctgtgccgaaacgcaaatggggaaacacccgctttttggatgattatgcattgtctccacattgtatgcttccaagattctggtgggaatactgctgatagcctaacgttcatgatcaaaatttaactgttctaacccctacttgacagcaatatataaacagaaggaagctgccctgtcttaaacctttttttttatcatcattattagcttactttcataattgcgactggttccaattgacaagcttttgattttaacgacttttaacgacaacttgagaagatcaaaaaacaactaattattgaaa

SEQ ID NO: 953 - DNA, 934 bp, Artificial sequence
  Synthesized
aacatccaaagacgaaaggttgaatgaaacctttttgccatccgacatccacaggtccattctcacacataagtgccaaacgcaacaggaggggatacactagcagcagaccgttgcaaacgcaggacctccactcctcttctcctcaacacccacttttgccatcgaaaaaccagcccagttattgggcttgattggagctcgctcattccaattccttctattaggctactaacaccatgactttattagcctgtctatcctggcccccctggcgaggttcatgtttgtttatttccgaatgcaacaagctccgcattacacccgaacatcactccagatgagggctttctgagtgtggggtcaaatagtttcatgttccccaaatggcccaaaactgacagtttaaacgctgtcttggaacctaatatgacaaaagcgtgatctcatccaagatgaactaagtttggttcgttgaaatgctaacggccagttggtcaaaaagaaacttccaaaagtcggcataccgtttgtcttgtttggtattgattgacgaatgctcaaaaataatctcattaatgcttagcgcagtctctctatcgcttctgaaccccggtgcacctgtgccgaaacgcaaatggggaaacacccgctttttggatgattatgcattgtctccacattgtatgcttccaagattctggtgggaatactgctgatagcctaacgttcatgatcaaaatttaactgttctaacccctacttgacagcaatatataaacagaaggaagctgccctgtcttaaacctttttttttatcatcattattagcttactttcataattgcgactggttccaattgacaagcttttgattttaacgacttttaacgacaacttgagaagatcaaaaaacaactaattattcgaaacg

SEQ ID NO: 954 - DNA, 425 bp, Artificial sequence
  Synthesized
tataactgtcgcctcttttatctgccgcactgcatgaggtgtccccttagtgggaaagagtactgagccaaccctggaggacagcaagggaaaaatacctacaacttgcttcataatggtcgtaaaaacaatccttgtcggatataagtgttgtagactgtcccttatcctctgcgatgttcttcctctcaaagtttgcgatttctctctatcagaattgccatcaagagactcaggactaatttcgcagtcccacacgcactcgtacatgattggctgaaatttccctaaagaatttttttttcacgaaaattttttttttacacaagattttcagcagatataaaatggagagcaggacctccgctgtgactcttcttttttttcttttattctcactacatacattttagttattcgccaac

SEQ ID NO: 955 - DNA, 587 bp, Artificial sequence
  Synthesized
cttcagtaatgtcttgtttcttttgttgcagtggtgagccattttgacttcgtgaaagtttctttagaatagttgtttccagaggccaaacattccacccgtagtaaagtgcaagcgtagcaagaccaagactggcataaatcaggtataagtgtcgagcactggcaggtgatcttctgaaagtttctactagcagataagatccagtagtcatgcatatggcaacaatgtaccgtgtggatctaagaacgcgtcctactaaccttcgcattcgttggtccagtttgttgttatcgatcaacgtgacaaggttgtcgattccgcgtaagcatgcatacccaaggacgcctgttgcaattccaagtgagccagttccaacaatctttgtaatattagagcacttcattgtgttgcgcttgaaagtaaaatgcgaacaaattaagagataatctcgaaaccgcgacttcaaacgccaatatgatgtgcggcacacaataagcgttcatatccgctgggtgactttctcgctttaaaaaattatccgaaaaaattttcttcccttctcttccaaatatcatctccacaaa

SEQ ID NO: 956 - DNA, 193 bp, Artificial sequence
  Synthesized
ggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 957 - DNA, 318 bp, Artificial sequence
  Synthesized
ctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcga

SEQ ID NO: 958 - DNA, 827 bp, Artificial sequence
  Synthesized
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatggggtctcatttattatttacaaattcacatatacaacaccaccgtccccagtgcccgcagtttttattaaacataacgtgggatctccacgcgaatctcgggtacgtgttccggacatgggctcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttggaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 959 - DNA, 827 bp, Artificial sequence
  Synthesized
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcag

SEQ ID NO: 960 - DNA, 825 bp, Artificial sequence
  Synthesized
gtaagtagaccaaggccttttattggctgcggtgttaaggcaagctgcctgtctatccctatctatctactatccacctggctctctagctccatactgcgtacggtgtttgttagcttagggtgatagcaagtagaacgctggtgatggttgctctctatcagtttagcgctggtgatggtggcctccttctccatttcttatatatatatgctggtgatggtccctcttccatggccgcggtgtgcttcggtgccgggtaccgtaacgtggtacagaaaaaggcctgacacgtacgcgtctctccctaggatgctatgtgtctgtagcaccggcggagcttgcgagctcgatgtccaagatagagtctccatgactgctcagatcgtctcctgtgttcacacaccagatattacaagcgacggccgccatgataagtccaaaaatgagcagaatacagaatattgtactcagaggctgcagccatcttggtggcctgctgtggtgctcttttcccgtggaggactccgtcagttcctgcgtgttgttgctcgtactgcgaagatctctcttgccccgtcctgaaaacctaggccctgacagaaaaaagggagagttaggagagggcacagaggattctgtctgtgtcaagggggcttccatgttgtttctttacctgagatctcttccaccagttgttttttatcagcaactgacaggtagtatatcaaaatgagtgcactgatgattattagcactgtatactttagatatcttctggtctctgtggacatctgttgatgataaaaaattatatttttttag

SEQ ID NO: 961 - DNA, 1246 bp, Artificial sequence
  Synthesized
gtaaggttgcattgggctcggctatgggacggggatttggcccggtactttaatatgggtggggtcttatgggtagggggcttattaatataacgccccctacccatacatattgcgtcacgtaattagaagccccctaccacgccattggcgcccgcccatagcggtactttcggttctatacaagatggctaccgcggttttcgatcgctcccgggggtctcatttctatagctggaaagcatccgacccccatgatctgtgccttagaccccagggtacgtgcctggataggtgggcgacccctagcggctgcttgtatttttatatcagagatcgaaaatcacagccgcccgtaacagctgtcagggctatacaagatggcgaccgctactttcgatcgctttttcttccctcgatcctgcttccgaaacgcaacccacccccggggtatgtgccttagaccctatagatgccccccaggacgcaggaaaaattttagctcccctctataattttattcgagcgatcgaaatccgcggaccgcccgggtttttactttcgttttctcggtcgccgctcggctcggattccgagcagaaaaagggctagaaagctgcgctcacctgccgaaacgcgttgttcggatcatcccgggagggccagcgtagtctccgttgctgggttcggccgagggatcgagtcgagcgggcggcgggacgccgggaacgagagaggatcgggagcgggcgcccgggtggctcgggagcggccgggagacggtctgcagagctccagagctgcgtgtcctgacactgaacagttgggaaaaatactggatcttataatgacccaggggaaggggtccgagatcctcccagtgtccgagactgccaagagacactcctgttgaaaagcagctctaaaacgttttcctgctcatctctgccagacccccgcccactgacagagctcaattgatagcagatgtcctctttggaaggacacacgcttccacaaacaccgttcctcactgaggtgcattgtctgggagggaaggtcaccttcttgttcattgtggacggtgtgcggcccaggcctcggacgaccctggcccgggcttccttcttcctgatccaggtagattgacgtgcggacatcgcgaacgaccgcagtcttcctgatctttgaatgactcgagtacatgagcgcacctttcgagactgatctctcttgttctccatag

SEQ ID NO: 962 - DNA, 1246 bp, Artificial sequence
  Synthesized
gtaaggttgcattgggctcggctatgggacggggatttggcccggtactttaatatgggtggggtcttatgggtagggggcttattaatataacgccccctacccatacatattgcgtcacgtaattagaagccccctaccacgccattggcgcccgcccatagcggtactttcggttctatacaagatggctaccgcggttttcgatcgctcccgggggtcacatttctatagctggaaagcatccgacccccatgatctgtgccttagaccccagggtacgtgcctggataggtgggcgacccctagcggctgcttgtatttttatatcagagatcgaaaatcacagccgcccgtaacagctgtcagggctatacaagatggcgaccgctactttcgatcgctttttcttccctcgatcctgcttccgaaacgcaacccacccccggggtatgtgccttagaccctatagatgccccccaggacgcaggaaaaattttagctcccctctataattttattcgagcgatcgaaatccgcggaccgcccgggtttttactttcgttttctcggtcgccgctcggctcggattccgagcagaaaaagggctagaaagctgcgctctcctgccgaaacgcgttgttcggatcatcccgggagggccagcgtagtctccgttgctgggttcggccgagggatcgagtcgagcgggcggcgggacgccgggaacgagagaggatcgggagcgggcgcccgggtggctcgggagcggccgggagagggtctgcagagctccagagctgcgtgtcctgacactgaacagttgggaaaaatactggatcttataatgacccaggggaaggggtccgagatcctcccagtgtccgagactgccaagagacactcctgttgaaaagcagctctaaaacgttttcctgctcatctctgccagacccccgcccactgacagagctcaattgatagcagatgtcctctttggaaggacacacgcttccacaaacaccgttcctcactgaggtgcattgtctgggagggaaggtcaccttcttgttcattgtggacggtgtgcggcccaggcctcggacgaccctggcccgggcttccttcttcctgatccaggtagattgacgtgcggacatcgcgaacgaccgcagtgttcctgatctttgaatgactcgagtacatgagcgcacctttcgagactgatctctcttgttctccatag

SEQ ID NO: 963 - DNA, 114 bp, Artificial sequence
  Synthesized
gtacgtgtcggggtttgtgccccccctttttttttaataaaattgtattaatgttatatacatatctcctgtatgtgacccatgtgcttatgactctatttctcatgtgtttag

SEQ ID NO: 964 - DNA, 170 bp, Artificial sequence
  Synthesized
gtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacag

SEQ ID NO: 965 - DNA, 122 bp, Artificial sequence
  Synthesized
gtgagtgtctcagttattcacatcatgactcttctaactatcttatctcctctacctgtctctgtctttcatattcacccacacagaacacttgagttatacaaaccactcttatattccag

SEQ ID NO: 966 - DNA, 181 bp, Artificial sequence
  Synthesized
gtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacag

SEQ ID NO: 967 - DNA, 213 bp, Artificial sequence
  Synthesized
gtaagtctgttgacatgtatgtgatgtatactaatctgcatgggacgtggatttacttgtgtatgtcagatagagtaaagattaactcttgcatgtgagcggggcatcgagatagcgataaatgagtcaggaggacggatacttatatgtgttgttatcctcctctacagagcctctgctaaccatgttcatgccttcttctttttcctacag

SEQ ID NO: 968 - DNA, 841 bp, Artificial sequence
  Synthesized
gtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagaagcctctgctaaccatgttcatgccttcttctttttcctacag

SEQ ID NO: 969 - DNA, 1133 bp, Artificial sequence
  Synthesized
gtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacag

SEQ ID NO: 970 - DNA, 943 bp, Artificial sequence
  Synthesized
gtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaag

SEQ ID NO: 971 - DNA, 923 bp, Artificial sequence
  Synthesized
gtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 972 - DNA, 943 bp, Artificial sequence
  Synthesized
gtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcag

SEQ ID NO: 973 - DNA, 943 bp, Artificial sequence
  Synthesized
gtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcag

SEQ ID NO: 974 - DNA, 938 bp, Artificial sequence
  Synthesized
gtaagtgccgtgtgtggttcccgcgggcctggcctctttacgggttatggcccttgcgtgccttgaattacttccactggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcag

SEQ ID NO: 975 - DNA, 948 bp, Artificial sequence
  Synthesized
gtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttag

SEQ ID NO: 976 - DNA, 944 bp, Artificial sequence
  Synthesized
gtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaag

SEQ ID NO: 977 - DNA, 971 bp, Artificial sequence
  Synthesized
gtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctag

SEQ ID NO: 978 - DNA, 971 bp, Artificial sequence; identical to SEQ ID NO: 977
  Synthesized

SEQ ID NO: 979 - DNA, 963 bp, Artificial sequence
  Synthesized
gtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggccccggagcgccggcggctgtcgaggcgcggcgagccgcagccattgccttttatggtaatcgtgcgagagggcgcagggacttcctttgtcccaaatctggcggagccgaaatctgggaggcgccgccgcaccccctctagcgggcgcgggcgaagcggtgcggcgccggcaggaaggaaatgggcggggagggccttcgtgcgtcgccgcgccgccgtccccttctccatctccagcctcggggctgccgcagggggacggctgccttcgggggggacggggcagggcggggttcggcttctggcgtgtgaccggcggctctag

SEQ ID NO: 980 - DNA, 971 bp, Artificial sequence
  Synthesized
gtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcgccaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctag

SEQ ID NO: 981 - DNA, 956 bp, Artificial sequence
  Synthesized
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggagacctggcttcctgccgtggggccgcctccggaccagcgtttgcctcttatggtaataacgcggccggcctgggcttcatttgtcccctgagtttgggcgcgcgccccctggcggcccgagaccgcggcttgccggaagtgggcagggcggcaacggctgcgcctagtggcccgccagtgaccgcgaccctcttttgtgccctgatatag

SEQ ID NO: 982 - DNA, 956 bp, Artificial sequence
  Synthesized
gtaagcagggacaacaggcccagccggccacagccctcccgtgggcagtgaccgcgctgcagggtcgcgggggacactcggcgcggacaccggggaaggctggagggtggtgccgggccgcggagcggacactttcagatccaactttcagtccagggtgtagaccctttacagccgcattgccacggtgtagacaccggtggacccgctctggctcagagcacgcggcttgggggaacccattagggtcgcagtgtgggcgctatgagagccgatgcagctttcgggtgttgaaccgtatctgcccaccttggggggaggacacaaggtcgggagccaaacgccacgatcatgccttggtggcccatgggtctttgtctaaaccggtttgcccatttggcttgccgggcgggcgggcgcggcgggcccggctcggccgggtgggggctgggttgccactgcgcttgcgcgctctatggctgggtattggggcgcgtgcacgctggggagggagcccttcctcttccccctctcccaagttaaacttgcgcgtgcgtattgagacttggagcgcggccaccggggttgggcgagggcggggccgttgtccggaaggggcggggtcgcagaggattcggggcgcctgctcgcgcttcctgctgggtgtggtcgcctcccgcgcgcgcactagaccgcccggcgggggggcgaaggcgggtcttgcgcccgtttggggagggggcggacacctggcttcctgccgtggggccgcctccggaccagcgtttgcctcttatggtaataacgcggccggcctgggcttcatttgtcccctgagtttgggcgcgcgccccctggcggcccgtgaccgcggcttgccggaagtgggcagggcggcaacggctgcgcctagtggcccgccagtgaccgcgaccctcttttgtgccctgatatag

SEQ ID NO: 983 - DNA, 959 bp, Artificial sequence
  Synthesized
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggagctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatag

SEQ ID NO: 984 - DNA, 959 bp, Artificial sequence
  Synthesized
gtaagcagggacgccgggcccagcgggccttcgctctctcgtggctagtacctcactgcagggtcctgaggatcactcagaacggacaccatgggcgggtggagggtggtgccgggccgcggagcggacactggcacagccaactttacgcctagcgtgtagactctttgcagccacattcccgcggtgtagacactcgtgggcccgctcccgctcggtgcgtggggcttggggacacactagggtcgcggtgtgggcatttgatgagccggtgcggcttgcgggtgttaaaagccgtattaggtccatcttgagagtacacagtattgggaaccagacgctacgatcacgcctcaatggcctctgggtctttgtccaaaccggtttgcctattcggcttgccgggcgggcgggcgggcgggcgggcgcggcagggccggctcggccgggtgggggctgggatgccactgcgcgtgcgctctctatcactgggcatcgaggcgcgtgtgcgctagggagggacctcttcctctccccctcttcctagttagctgcgcgtgcgtattgaggctgggagcgcggctgcccggggttgggcgagggcggggccgttgtccggaaggggcggggtcacagtggcacgggcgccttgtttgcgcttcctgctgggtgtggtcgcctcccgcgcgcgcacaagccgcccgtcggcgcagtgtaggcggagcttgcgcccgtttggggagggggcggaggtctggcttcctgccctaggtccgcctccgggccagcgtttgccttttatggtaataatgcggccggtctgcgcttcctttgtcccctgagcttgggcgcgcgccccctggcggctcgagcccgcggcttgccggaagtgggcagggcggcagcggctgctcttggcggccccgaggtgactatagccttcttttgtgtcttgatag

SEQ ID NO: 985 - DNA, 929 bp, Artificial sequence
  Synthesized
gtaagcagggacgtcgggcccagcgggccccaactttaccttggccactacctcgctgcaggatcgtgaggaacactcagaagggacaccgtagaggggtggagcgtggtaccgggccgcggagcagctggcaaagcttaactttcccggcccctagggtgtagagtgtttgcagtcgtattcccgcggtgtggacactcgtgggtacgctcctgcttggtgcgcggggcttggggacacactagagtcgcggtgtgggcatttggagagccggtgcggctgcgggtgttaagccgcatctgtccaccttgaggggcaacagtattggggtcaggcgttacaatcacgctttgatggcctatgggtctttgtccaaaccggttttgccattcggcttggcgggcgcggcggggccgctcggccgggtgggggctgggatgccattgcgcgtgcgcgctctatcactgggcattggggccgtgcgcgctggggagggaactcttcctctccccctcttccgagttaagagttgcgcgtgcgtattgagactaggagcgcggccgccccgggttgggcgagggcgggccgtccaccggaaggggcggggtcgtagcggctaggcgcctgctcgcgcttcctgctgggtgtggtcgcctcccgcgcgcgcactagccgcccgtcgcctcagtgtaggcgggcctgtgcccgtttggggaggggcggaggcctggcttcctgccgtgggtccgcctccgggccagcgtttgccttttatggtaataatgcggctgtcctgcgcttcctttgtcccctgagcttgggcgcgcccctggcggctcgaggccgcggctcgccggaagtgggcagggcggcagcggctgctcttggcggctccgcggtgaccatagccctcttttgtgccttgatag

SEQ ID NO: 986 - DNA, 240 bp, Artificial sequence
  Synthesized
gtaaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcag

SEQ ID NO: 987 - DNA, 240 bp, Artificial sequence
  Synthesized
gtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcag

SEQ ID NO: 988 - DNA, 188 bp, Artificial sequence
  Synthesized
gtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccag

SEQ ID NO: 989 - DNA, 1018 bp, Artificial sequence
  Synthesized
gtgagtgaccccggagcggcggtgctcggggccggagacggtacctcggggctgcgggacgtgtcggtggcggtccgcggaggccggcctgggaggagacatggctgccggggcggcgggacgtggacggacggggcggctggcgccatgtctgcgcgtcgggctgtggcctcggcacggcggccgttgtcccctcggcggacggtgctgatttggcagtgggcacagccaggcctctggccgccctcgggcgtgggatcgctggtcccgtccccggcggagggccagcgtccctttacgaggtgacagccgggtgggcggtcttccgtttgcacatccgcgtcccctgtggccggcctccgcgcgtcacgtcgctgctgtaggaccccctcctgaacggtgacgtgctccctgctaaccaaatggattccgaaggtagcctgggcaagggctctcgcatcccgccatgtggaacccgctggctttgggtggcgcaaagcgtgtcccatgccgagcgtctggaggttctgtgcctccacacgtgtggacccatcgagttgtcatgagtagtgtcctgctgaggttcccacgcacttctaggcactgcttgcttggctgtgaagctggggtggcaggcgcagttttgttgcctgtggatgcgttggaagattgggggcctttggttattgcggtggtgactgtctttgagatagggtttcacgtagcccaggcttgctcaggtggttagttcagggtttgtttagttagggctggacttctgacgtgctggctgtggactcttgatctgtatgctaacgaggtgcttgggcttgcaggctcgagtcaccgcggactcactgttccttatgaatgacaaccgaggctccatcttgggctgacggtcgtggttgtagtggctgtgtgcgcactggagtgttgtgtgggcaggccacggccacgcgtgggaaacgacatgctgctgcctgcagtttgctcagctgcccctcccccatcccag

SEQ ID NO: 990 - DNA, 1018 bp, Artificial sequence
  Synthesized
gtgagtgaccccggagcggcggtgctcggggccggagtcggtacctcggggctgcgggacgtgtcggtggcggtccgcggaggccggcctgggaggagacatggctgccggggcggcgggacgtggacggacggggcggctggcgccatgtctgcgcgtcgggctgtggcctcggcacggcggccgttgtcccctcggcggacggtgctgatttggcagtgggcacagccaggcctctggccgccctcgggcgtgggatcgctggtcccgtccccggcggagggccagcgtccctttacgaggtgacagccgggtgggcggacttccgtttgcacatccgcgtcccctgtggccggcctccgcgcgtcacgtcgctgctgtaggaccccctcctgaacggtgacgtgctccctgctaaccaaatggattccgaaggtagcctgggcaagggctctcgcatcccgccatgtggaacccgctggctttgggtggcgcaaagcgtgtcccatgccgagcgtctggaggttctgtgcctccacacgtgtggacccatcgagttgtcatgagtagtgtcctgctgaggttcccacgcacttctaggcactgcttgcttggctgtgaagctggggtggcaggcgcagttttgttgcctgtggatgcgttggaagattgggggcctttggttattgcggtggtgactgtctttgagatagggtttcacgtagcccaggcttgctcaggtggttagttcagggtttgtttagttagggctggacttctgacgtgctggctgtggactcttgatctgtatgctaacgaggtgcttgggcttgcaggctcgagtcaccgcggactcactgttccttatgaatgacaaccgaggctccatcttgggctgacggtcgtggttgtagtggctgtgtgcgcactggagtgttgtgtgggcaggccacggccacgcgtgggaaacgacatgctgctgcctgcagtttgctcagctgcccctcccccatcccag

SEQ ID NO: 991 - DNA, 1028 bp, Artificial sequence
  Synthesized
gtgagtaaccctgcctcgctggtgccccggagcggcggcggggcctccgcggggcctacgctgcctagcctgggacgctggggccccccgtgccaggaggagacgtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccag

SEQ ID NO: 992 - DNA, 1027 bp, Artificial sequence
  Synthesized
gtgagtaaccctgcctcgctggtgccccggagcggcggcggggcctccgcggggcctacgctgcctagcctgggacgctggggccccccgtgccaggaggagaggtagcggcggcggggccggaggacccggggctggggaagcggccgccgccatgtctgtgcgccgcgctgttcaccgagccctttctccgtttccgagggcgccataaccttgcccagacctggttggagctgggttgttagcggggatgggggtggggaatgatgatgtggcaggcgtagtaatggcgggcaccgcggtggaagcggggagacagggaggcgccttatgtaacccgcgggccgcgagtttgagatcgattttctgccgggggactaggggcggcagggaatggcagaacgagcaaagcgacacctgaaaggctccccttttccttccaaataccttctcctgatgctgttaatcgtcgaccttaggcacttgtccttcctatgactcccagatgtacaaagactcttattgagacacgaggtgtaggcttgtggcagttagggccgttccggctccccgttatttcctggggtgggtggccttgtctgatcccgtttgccaaggggtgaccttgcattttatgatgaagcttcttgctcggggaagtttgggtggcccggtgacaacgtggagggggctttaggagaggattcatcccttacgtgtttggccccaaatgagactttagtatttgtacctggtatcaaggaaatctgttgacactcagttttattcctgagcacttttatttctgggttgtcaatcatgaatgacacctattaacggtggttccttggagattgcggggtggctcttaaggggtgttaggctggcaagattcggtgggcttggggcaccccagcaccaaccccctcctggccttgggcatgctggttcgtttggactgaacgctccgtgccatgctgtgttcctggaaatcacgagctggtctgagcctccttgtcttgcccag

SEQ ID NO: 993 - DNA, 935 bp, Artificial sequence
  Synthesized
gtgagtctcctcggctccgctagactcggggaccgagacgaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtctctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtcttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacag

SEQ ID NO: 994 - DNA, 935 bp, Artificial sequence
  Synthesized
gtgagtctcctcggctccgctagactcggggaccgagaggaatctctggggcagcgggacgtggctgtagcgggacgctgagagggacgggaggaagagacatggctgccctggcccgggcggcaggacgtggtcgggccgcggcgccatatctgcgcgtccctgagggccttgggagtgtcaactgccgaggtcggggtgttttcttgaagtccttcaactccccgcggccgccggggtgactgcgggaggggttgtgcttggtgatgtggcagcgggcaaagcgccgtccccgcgcccctggtgacgggcggagggtgtcctcgggaggtgacagcctgtagggctggcttccttggacacctccagtgggctgaacgccttccgggccctttccggtagcccccgtgtctgttttctatctgagttcacacgtgagcaccggtccccataatctaagaaagtggctcactgggcctagtggcgcattgtggcctttgatccgggctttgaccttggcgcacagcacccagtggtttggggaagaggtgtgtgtagcagaggaggttttttcgtgctttggtcccaatcaatccggcatctttgcagtgccgaggtggccgtgcaccttggctttgaattcttgtgctgaggttatgtgacttgagcctcaagatagggtgttctagcacaggcttgctcttaagtgtcgcagttgtcggtttcggcgtttgtttagagctgtggacacatctgtgaacttttgatgcttatttcagaggtcctgggttgtacgtttgagtcacactgtgagctcagctccaatcttgggccgacatctggttcctgcccctgctgtggggtgctattgacccaccgatgcctgccaagttgggttcccagaatcagcctggctgcccatccccccaccacag

SEQ ID NO: 995 - DNA, 874 bp, Artificial sequence
  Synthesized
gtgagtgtccgcggcgcggcaagacttggggactgagacgagtcttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggagacctctagtgagctgagcgtcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtctcagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacag

SEQ ID NO: 996 - DNA, 874 bp, Artificial sequence
  Synthesized
gtgagtgtccgcggcgcggcaagacttggggactgtgacgagacttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggtgacctctagtgagctgagcctcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtcacagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacag

SEQ ID NO: 997 - DNA, 66 bp, Simian virus 40
gtaaatataaaatttttaagtgtataatgtgttaaactactgattctaattgtttgtgtattttag

SEQ ID NO: 998 - DNA, 1363 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttgcttgttctttttgcagaagctcagaataaacgctcaactttggccgccaccatg

SEQ ID NO: 999 - DNA, 1116 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccaccatg

SEQ ID NO: 1000 - DNA, 1549 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccaccatg

SEQ ID NO: 1001 - DNA, 2193 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacaccatctattgcttacatttgcttctgacacaactgtgttcactagcaacctcaaacagacaccatg

SEQ ID NO: 1002 - DNA, 2147 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgactacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtaaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagcttgcttgttctttttgcagaagctcagaataaacgctcaactttggccgccaccatg

SEQ ID NO: 1003 - DNA, 1637 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccaccatg

SEQ ID NO: 1004 - DNA, 2036 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcgtctcaggggcgagacctctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccaccatg

SEQ ID NO: 1005 - DNA, 1515 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagcgtctcaggggcgagacctctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccaccatg

SEQ ID NO: 1006 - DNA, 2108 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttgcttgttctttttgcagaagctcagaataaacgctcaactttggccgccaccatg

SEQ ID NO: 1007 - DNA, 1587 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagacccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagagcttgcttgttctttttgcagaagctcagaataaacgctcaactttggccgccaccatg

SEQ ID NO: 1008 - DNA, 1910 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccagcttgcttgttctttttgcagaagctcagaataaacgctcaactttggccgccaccatg

SEQ ID NO: 1009 - DNA, 1389 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccagcttgcttgttctttttgcagaagctcagaataaacgctcaactttggccgccaccatg

SEQ ID NO: 1010 - DNA, 2126 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgactacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggcgagaccggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaacgccgccaccagcttgcttgttctttttgcagaagctcagaataaacgctcaactttggccgccaccatg

SEQ ID NO: 1011 - DNA, 1013 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaaacttcgtgaggctccggtgcccgtcagtgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccagcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagccatctattgcttacatttgcttctgacacaactgtgttcactagcaacctcaaacagacaccaatg

SEQ ID NO: 1012 - DNA, 2038 bp, Artificial sequence
  Synthesized
ggtattatccctaatacctgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgacacccattaaaaaagttaaatgagaaacctgtgtgttcctttggagaggggcggaagggacgttaggagggaggcagggaggcagggaggcagggaggaacggagggaggaaacttgatctgtcgccgcaattcaagcttcgtgaggctccggtgcccgtcagtgacctgctatactctggagacgctgggaagggtccctaggattgtgcacctctcccgcgggggacaagcaggggatggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgttctttttcgcaacgggtttgccgtcagaacgcaggtgagtggcgggtgtggcctccgcgggcccgggctccctcctttgagcggggtcggaccgccgtgcgggtgtcgtcggccgggcttctctgcgagcgttcccgccctggatggcgggctgtgcgggagggcgagggggggaggcctggcggcggccccggagcctcgcctcgtgtcgggcgtgaggcctagcgtggcttccgccccgccgcgtgccaccgcggccgcgctttgctgtctgcccggctgccctcgattgcctgcccgcggcccgggccaacaaagggagggcgtggagctggctggtagggagccccgtagtccgcatgtcgggcagggagagcggcagcagtcgggggggggaccgggcccgcccgtcccgcagcacatgtccgacgccgcctggacgggtagcggcctgtgtcctgataaggcggccgggcggtgggttttagatgccgggttcaggtggccccgggtcccggcccggtctggccagtaccccgtagtggcttagctccgaggagggcgagcccgcccgcccggcaccagttgcgtgcgcggaaagatggccgctcccgggccctgtagcaaggagctcaaaatggaggacgcggcagcccggcggagcggggcgggtgagtcacccacacaaaggaagagggccttgcccctcgccggccgctgcttcctgtgaccccgtggtgtaccggccgcacttcagtcaccccgggcgctctttcggagcaccgctggcctccgctgggggaggggatctgtctaatggcgttggagtttgctcacatttggtgggtggagactgtagccaggccagcctggccatggaagtaattcttggaatttgcccattttgagtttggagcgaagctgattgacaaagctgcttagccgttcaaaggtattcttcgaactttttttttaaggtgttgtgaaaaccaccgctaattcaaatccaacagcttgcttgttctttttgcagaagctcagaataaacgctcaactttggccgccaccatg

SEQ ID NO: 1013 - DNA, 1985 bp, Artificial sequence
  Synthesized
ggtattatccctaatacctgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgacacccattaaaaaagttaaatgagaaacctgtgtgttcctttggagaggggcggaagggacgttaggagggaggcagggaggcagggaggcagggaggaacggagggaggaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagctaattcaaatccaacagcttgcttgttctttttgcagaagctcagaataaacgctcaactttggccgccaccatg

SEQ ID NO: 1014 - DNA, 2567 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacgtctcaggggctgtcttcgcaggagcccgggctgggcataaaagtcagggcagagccatctattgcttacatttgcttctgacacaactgtgttcactagcaacctcaaacagacaccatg

SEQ ID NO: 1015 - DNA, 2566 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaacgtctcaggggctgtcttcgcaggagcccgggctgggcataaaagtcagggcagagccatctattgcttacatttgcttctgacacaactgtgttcactagcaacctcaaacagacaccatg

SEQ ID NO: 1016 - DNA, 2016 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagtctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccaccatg

SEQ ID NO: 1017 - DNA, 2052 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacaacctttggagctaagccagcaatggtagagggaagattctgcacgtcccttccaggcggcctccccgtcaccaccccccccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtttctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcgaggtgaggtgtggcaggcttgagatccagctgttggggtgagtactccctctcaaaagcgggcattacttctgcgctaagattgtcagtttccaaaaacgaggaggatttgatattcacctggcccgatctggccatacacttgagtgacaatgacatccactttgcctttctctccacaggtgtccactcccaggtccaagtttaaagccgccaccatg

SEQ ID NO: 1018 - DNA, 2106 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggtagcttgcttgttctttttgcagaagctcagaataaacgctcaactttggccgccaccatg

SEQ ID NO: 1019 - DNA, 2764 bp, Artificial sequence
  Synthesized
ggtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcctctggagacggtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacatacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgaccttccccggctactgaagcgcatcggacccgctcggttctattgggaccacgcccatccgccatattggaacagccgccatattggtaacgccgccatcttgattgggaccaccgcccctattgggaccaccgcccaattgggaccaccgcccacccagcgacccaggcccagaggctacgtcaccaggacccccggctgcccagcgccccctcgaggacacacaatgtaagtagaccaaggccttttattggctgcggtgttaaggcaagctgcctgtctatccctatctatctactatccacctggctctctagctccatactgcgtacggtgtttgttagcttagggtgatagcaagtagaacgctggtgatggttgctctctatcagtttagcgctggtgatggtggcctccttctccatttcttatatatatatgctggtgatggtccctcttccatggccgcggtgtgcttcggtgccgggtaccgtaacgtggtacagaaaaaggcctgacacgtacgcttctctccctaggatgctatgtgtctgtagcaccggcggagcttgcgagctcgatgtccaagatagagtctccatgactgctcagattgtctcctgtgttcacacaccagatattacaagcgacggccgccatgataagtccaaaaatgagcagaatacagaatattgtactcagaggctgcagccatcttggtggcctgctgtggtgctcttttcccgtggaggactccgtcagttcctgcgtgttgttgctcgtactgcgaagatctctcttgccccgtcctgaaaacctaggccctgacagaaaaaagggagagttaggagagggcacagaggattctgtctgtgtcaagggggcttccatgttgtttctttacctgagatctcttccaccagttgttttttatcagcaactgacaggtagtatatcaaaatgagtgcactgatgattattagcactgtatactttagatatcttctggtttctgtggacatctgttgatgataaaaaattatatttttttagagagcgtctcaggggtgtgtcgtgaaaactacccctagccgccaccatg

SEQ ID NO: 1020 - DNA, 2571 bp, Artificial sequence
  Synthesized
ggtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcacgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgcgctgccttcgccccgtgccccgctccgccgccgcctcgcgccgcccgccccggctctgactgaccgcgttactcccacaggtgagcgggcgggacggcccttctcctccgggctgtaattagcgcttggtttaatgacggcttgtttcttttctgtggctgcgtgaaagccttgaggggctccgggagggccctttgtgcggggggagcggctcggggggtgcgtgcgtgtgtgtgtgcgtggggagcgccgcgtgcggctccgcgctgcccggcggctgtgagcgctgcgggcgcggcgcggggctttgtgcgctccgcagtgtgcgcgaggggagcgcggccgggggcggtgccccgcggtgcggggggggctgcgaggggaacaaaggctgcgtgcggggtgtgtgcgtgggggggtgagcagggggtgtgggcgcgtcggtcgggctgcaaccccccctgcacccccctccccgagttgctgagcacggcccggcttcgggtgcggggctccgtacggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgctgtctcatcattttggcaaagaattcggcttgatcgaagccgtctcaggggagagaccacacccaagctgtctagagccgccaccatg

SEQ ID NO: 1021 - DNA, 2442 bp, Artificial sequence
  Synthesized
ggtcttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctctggagacgctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgcgtctcaggggcgtgtcgtgaaaactacccctagccgccaccatg

SEQ ID NO: 1022 - DNA, 2048 bp, Artificial sequence
  Synthesized
ggtatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcctctggagacggtagcatccttaggatcgagtcaatgggaaaaacccattggagccaagtacactgactcaatagggactttccattgggttttgcccagtacataaggtcaatagggggtgagtcaacaggaaagtcccattggagccaagtacattgagtcaatagggactttccaatgggttttgcccagtacataaggtcaatgggaggtaagccaatgggtttttcccattactgacatgtatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgctcagatcgcctggagaggccatccacgctgttttgacctccatagtggacaccgggaccgatccagcctccgcggccgggaacggtgcattggaacgcggattccccgtgccaagagtgacgtaagtctgttgacatgtatgtgatgtatactaatctgcatgggacgtggatttacttgtgtatgtcagatagagtaaagattaactcttgcatgtgagcggggcatcgagatagcgataaatgagtcaggaggacggatacttatatgtgttgttatcctcctctacagagcctctgctaaccatgttcatgccttcttctttttcctacagctccgtctcaggggcaagcttgcttgttctttttgcagaagctcagaataaacgctcaactttggccgccaccatg

SEQ ID NO: 1023 - DNA, 1089 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaaacttcgtgaggctccggtgcccgtcagtgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatggtcgaggtgagccccacgttctgcttcactctccccatctcccccccctccccacccccaattttgtatttatttattttttaattattttgtgcagcgatgggggcgggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcggccatctattgcttacatttgcttctgacacaactgtgttcactagcaacctcaaacagacaccaatg

SEQ ID NO: 1024 - DNA, 1652 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaaacttcgtgaggctccggtgcccgtcagtggcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacaccatctattgcttacatttgcttctgacacaactgtgttcactagcaacctcaaacagacaccaatg

SEQ ID NO: 1025 - DNA, 1005 bp, Artificial sequence
  Synthesized
ggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagaaacttgatctgtcgccgcaattcaaacttcgtgaggctccggtgcccgtcagtgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacagccatctattgcttacatttgcttctgacacaactgtgttcactagcaacctcaaacagacaccaatg

SEQ ID NO: 1026 - DNA, 1836 bp, Artificial sequence
  Synthesized
ccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 1027 - DNA, 1923 bp, Artificial sequence
  Synthesized
ccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 1028 - DNA, 2494 bp, Artificial sequence
  Synthesized
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 1029 - DNA, 901 bp, Artificial sequence
  Synthesized
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaggggcttcgcaggtacacccaagctgtctagagccgccacc

SEQ ID NO: 1030 - DNA, 1549 bp, Artificial sequence
  Synthesized
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccaccatgg

SEQ ID NO: 1031 - DNA, 2105 bp, Artificial sequence
  Synthesized
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccagcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacaccatctattgcttacatttgcttctgacacaactgtgttcactagcaacctcaaacagacaccatgg

SEQ ID NO: 1032 - DNA, 1087 bp, Artificial sequence
  Synthesized
attatccctaatacctgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgacacccattaaaaaagttaaatgagaaacctgtgtgttcctttggagaggggcggaagggacgttaggagggaggcagggaggcagggaggcagggaggaacggagggaggaaacttgatctgtcgccgcaattcaagcttcgtgaggctccggtgcccgtcagtgacctgctataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccaccatgg

SEQ ID NO: 1033 - DNA, 995 bp, Artificial sequence
  Synthesized
atctgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaaacttgatctgtcgccgcaattcaagcttcgtgaggctccggtgcccgtcagtgacctgctataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgagcttgcttgttctttttgcagaagctcagaataaacgctcaactttggccgccaccatgg

SEQ ID NO: 1034 - DNA, 53 bp, Artificial sequence
  Synthesized
ggtctcaggggacacccaagctgtctagagccgccaccatgtaaaatgagacc

SEQ ID NO: 1035 - DNA, 1698 bp, Artificial sequence
  Synthesized
cttgctcacctcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggtattcggacggtgacgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctcgagccacc

SEQ ID NO: 1036 - DNA, 2454 bp, Artificial sequence
  Synthesized
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatgg

SEQ ID NO: 1037 - DNA, 2407 bp, Artificial sequence
  Synthesized
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtcttttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccacc

SEQ ID NO: 1038 - DNA, 1820 bp, Artificial sequence
  Synthesized
ccgcctaggactgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccgctaattcaaagcaagccgccacc

SEQ ID NO: 1039 - DNA, 2478 bp, Artificial sequence
  Synthesized
ccgcctaggacatattatccctaatacttgccaccccactcttaatcagtggtggaagaacggtgtcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagatccattaaaaaagttaaatgagaaacctgtgtgttcctttggtcaacaccgagacatttaggtgaaagcatatactgagattgagattaacttcctgtgaaacccagtgtcttagacaactgtggcttgagcaccacctgttggtattcattacaaacttgctcactacaataaatgaattttaagctttaagatgaagtggcatttcttttaacagttactatgttggaattggttacaaattttggagtggactattgtatatatatatcagttactgttatggatcccacgtcactattgtatactctatattatactctatgttatactctgtaatcctactcaataaacgtgtcacgcctgtgaaaccgtactaagtctcccgtgtcttgttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccaacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccaagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtgagtggcgggtgtggcttccgcgggccccggagctggagccctgctctgagcgggccgggctgatatgcgagtgtcgtccgcagggtttagctgtgagcattcccacttcgagtggcgggcggtgcgggggtgagagtgcgaggcctagcggcaaccccgtagcctcgcctcgtgtccggcttgaggcctagcgtggtgtccgccgccgcgtgccactccggccgcactatgcgttttttgtccttgctgccctcgattgccttccagcagcatgggctaacaaagggagggtgtggggctcactcttaaggagcccatgaagcttacgttggataggaatggaagggcaggaggggcgactggggcccgcccgccttcggagcacatgtccgacgccacctggatggggcgaggcctgtggctttccgaagcaatcgggcgtgagtttagcctacctgggccatgtggccctagcactgggcacggtctggcctggcggtgccgcgttcccttgcctcccaacaagggtgaggccgtcccgcccggcaccagttgcttgcgcggaaagatggccgctcccggggccctgttgcaaggagctcaaaatggaggacgcggcagcccggtggagcgggcgggtgagtcacccacacaaaggaagagggccttgcccctcgccggccgctgcttcctgtgaccccgtggtctatcggccgcatagtcacctcgggcttctcttgagcaccgctcgtcgcggcggggggaggggatctaatggcgttggagtttgttcacatttggtgggtggagactagtcaggccagcctggcgctggaagtcattcttggaatttgcccctttgagtttggagcgaggctaattctcaagcctcttagcggttcaaaggtattttctaaacccgtttccaggtgttgtgaaaaccaccgctaattcaaagcaagccgccacc

SEQ ID NO: 1040 - DNA, 2502 bp, Artificial sequence
  Synthesized
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaaagcttgcttgttctttttgcagaagctcagaataaacgctcaactttggccgccaccatgg

SEQ ID NO: 1041 - DNA, 1906 bp, Artificial sequence
  Synthesized
atcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagacgccatccacgctgttttgacctccatagaagataccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggagcctctgctaaccatgttcatgccttcttctttttcctacagctcctgggcaacgtgctggttattgtgctgtctcatcattttggcaaagaatttcaccgtccttgacacgaagtttgctcgagccacc

SEQ ID NO: 1042 - DNA, 1996 bp, Artificial sequence
  Synthesized
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaagcttgcttgttctttttgcagaagctcagaataaacgctcaactttggccgccacc

SEQ ID NO: 1043 - DNA, 1411 bp, Artificial sequence
  Synthesized
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatctctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggtagcttgcttgttctttttgcagaagctcagaataaacgctcaactttggccgccacc

SEQ ID NO: 1044 - DNA, 917 bp, Artificial sequence
  Synthesized
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaagcttgcttgttctttttgcagaagctcagaataaacgctcaactttggccgccacc

SEQ ID NO: 1045 - DNA, 1797 bp, Artificial sequence
  Synthesized
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcggccgccaagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaaagcttgcttgttctttttgcagaagctcagaataaacgctcaactttggccgccacc

SEQ ID NO: 1046 - DNA, 2363 bp, Artificial sequence
  Synthesized
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcctgaacacgtctcaagcttgcttgttctttttgcagaagctcagaataaacgctcaactttggccgccaccatgg

SEQ ID NO: 1047 - DNA, 1778 bp, Artificial sequence
  Synthesized
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccaatgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccagcgtctcaggggccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaaggggtagcttgcttgttctttttgcagaagctcagaataaacgctcaactttggccgccaccatgg

SEQ ID NO: 1048 - DNA, 1304 bp, Artificial sequence
  Synthesized
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtagaacgcagagctcctcgctgcagtatcctgcccaagaaagagcgacccgtctcaagcttgcttgttctttttgcagaagctcagaataaacgctcaactttggccgccaccatgg

SEQ ID NO: 1049 - DNA, 2176 bp, Artificial sequence
  Synthesized
gggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaaagcttgcttgttctttttgcagaagctcagaataaacgctcaactttggccgccaccatgg

SEQ ID NO: 1050 - DNA, 1052 bp, Salmonid alphavirus
ggggatctcccccgcggcagctggttacagctgtcgcggacggagatcatcccccggccaccccctttcgacgcgggtactgcgatagtgccaccccagtctttcctactcccgactcccgactctaacccaggttccttggaacaggaacaccaatatactcatcccctggatgctgactaatcagaggaacgtcagcattttccggcccaggctaagagaagtagataagttagattccaaattgatttatcatccccttgacgaattcgcgttggaaatgcacctctcacttgccgctctccacacccattaacttgattcggcctctgtgttgagccccttgttgaagtgcttccctccatcgtgacgtggttggagatctaagtcaaccgactccgacgaaactaccatcatgcctccccgattatgtgatgctttctgccctgctgggtggagcatcctcgggttgagaaaaccttcttcctttttccttggaccccggtcccccggtctaagccgcttggaataagacagggttatcttcacctcttccttcttctacttcatagtgttctatactatgaaagggtatgtgtcgccccttccttctttggagaacacgcgcggcggtctttccgtctctcgaaaagcgcgtgtgcgacatgcagagaaccgtgaagaaagcagtttgcggactagctttagtgcccacaagaaaacagctgtagcgaccacacaaaggcagcggaccccccctcctggcaacaggagcctctgcggccaaaagccacgtggataagatccacctttgtgtgcggcacaaccccagtgccctggtttcttggtgacacttcagtgaaaacgcaaatggcgatctgaagcgcctctgtaggaaagccaagaatgtccaggaggtaccccttccctcgggaagggatctgacctggagacacatcacatgtgctttacacctgtgcttgtgtttaaaaattgtcacagctttcccaaaccaagtggtcttggttttcactctttaaactgatttcact

SEQ ID NO: 1051 - DNA, 574 bp, Encephalomyocarditis virus
ccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaacgtctaggccccccgaaccacggggacgtggttttcctttgaaaaacacgatgataatatggccacaacc

SEQ ID NO: 1052 - DNA, 741 bp, Echovirus
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacactcaactacgttttattgctgaatagtgcaag

SEQ ID NO: 1053 - DNA, 565 bp, Encephalomyocarditis virus
ccccccccctaacgttactggccgaagccgcttggaataaggccggtgtgcgtttgtctatatgttattttccaccatattgccgtcttttggcaatgtgagggcccggaaacctggccctgtcttcttgacgagcattcctaggggtctttcccctctcgccaaaggaatgcaaggtctgttgaatgtcgtgaaggaagcagttcctctggaagcttcttgaagacaaacaacgtctgtagcgaccctttgcaggcagcggaaccccccacctggcgacaggtgcctctgcggccaaaagccacgtgtataagatacacctgcaaaggcggcacaaccccagtgccacgttgtgagttggatagttgtggaaagagtcaaatggctctcctcaagcgtattcaacaaggggctgaaggatgcccagaaggtaccccattgtatgggatctgatctggggcctcggtacacatgctttacatgtgtttagtcgaggttaaaaaacgtctaggccccccgaaccacggggacgtggttttcctttgaaaaacacgatgataatatg

SEQ ID NO: 1054 - DNA, 716 bp, Coxsackievirus
ttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagattgttaccatatagctattggattggccatccggtgaccaatagagctattatatatctctttgttgggtttataccacttagcttgaaagaggttaaaacattacaa

SEQ ID NO: 1055 - DNA, 669 bp, Coxsackievirus
gttttacacccccttaccctaatagcaacttagaaggctcaatgcatctacgaccaatagcaggcgcgacggcaccaagtcgtgtctcggtcaagcacttctgtttccccgggaccgagtatcaatagactgctcacgcggttgaaggagaaagcgttcgttacccggccatctacttcgagaagcctagtaacaccatgaaagttgcagagcgtttcgctcagcacttcccccgtgtagatcaggccgatgagtcactgcaaccctcacgggcgaccgtggcagtggctgcgttggcggcctgcccatgggattacccatgggacgctctaatacagacatggtgtgaagaacctattgagctagttggtagtcctccggcccctgaatgcggctaatcctaactgcggagcatacaccctcaatccagggggcagtgtgtcgtaacgggcaactctgcagcggaaccgactactttgggtgtccgtgtttccttttattcttattatggctgcttatggtgacaattgagagattgttgccatatagctattggattggccatccggtgagcaatagagcgattatttactcttttgttggatttgtgccattggatcacaccacaatcatcacactaaagtatattttactattaaatacagcaaa

SEQ ID NO: 1056 - DNA, 741 bp, Echovirus
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacactcaactacgttttattgctgaagccgccacc

SEQ ID NO: 1057 - DNA, 741 bp, Echovirus; identical to SEQ ID NO: 1052

SEQ ID NO: 1058 - DNA, 649 bp, Theiler's Murine Encephalomyocarditis virus
gacgaaactaccatcatgcctccccgattatgtgatgctttctgccctgctgggtggagcaccctcgggttgagaaaaccttcttcctttttccttggactccggtcccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagaaagcagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacactctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttttcactttttatcacactgtcaat

SEQ ID NO: 1059 - DNA, 1064 bp, Theiler's Murine Encephalomyocarditis virus
ttgaaagggggcccgggggatctcccccgcggtaactggtgacagttgtcgcggacggagatcatcccccggttaccccctttcgacgcgggtactgcgatagtgccaccccagtctttcctactcccgactcccgaccctaacccaggttcctcggaacaggaacaccaatttactcatcccctggatgctgactaatcagaggaacgtcagcattttccggcccaggctaagagaagtagataagttagaatccaaattgatttatcatccccttgacgaattcgcgttggaaaaacacctctcacttgccgctcgttacacccattaatttaattcggcctctgtgttgagccccttgttgaagtgtttccctccatcgcgacgtggttggagatctaagtcaaccgactccgacgaaactaccatcatgcctccccgattatgtgatgctttctgccctgctgggtggagcaccctcgggttgagaaaaccttcttcctttttccttggactccggtcccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagaaagcagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacactctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttttcactttttatcacactgtcaat

SEQ ID NO: 1060 - DNA, 1051 bp, Artificial sequence
  Synthesized
ttcaaaggggggccccggggtcttcgccgcggacacgcgttagtgtgttcgcggtgaagatcaccccgggaaaccccctttggacgcgggacctgcgacagtgccatcccccgtctctcctattccaactacccgaccctaacccagggtccaggacactggatcaatacaagtcatcccctgaatgctggctaatcagaggaaagtcagcattttccggcccaggctaagagaaacacaataagttagaatctaaattaatcaccttgacgaattcgcaaagataagtcctccctcccttgccgctcgatcacacccagaactaacaattcggcctctcgtgacgagccccttggtgaaaggacctctttcaacgcgacgtggttggagattaaaaccgactccgacgaaagtgctatcatgcctccccgattatgtgatgttttctgccctgctgggcggagcattctcgggttgatataccttgaatccttcatccttggacctcccggtcccccggtctaagccacttggaatatgacagggttattttccaaaattcttatttccactttcatgagttcttttcatgaaaagggtatgtgctgccccttccttcttggagaatccgcgtggcggtctttccgtctctcgaaaaacgtggatgcagcatgctggaaacggtgaagaaagtagttctctgtggaaacttagaacagacatcgaaacagctgtagcgacctcacagtagcagcggaaccccctcctggcgacaggagcctctgcggccaaaagccccgtggataagatccactgctgtgagcggtgcaaccccagcaccctggttcgatggttgttctctgtggaatcagagaatggctttcctaagccctccagtagagaagccaagaatgtcctgaaggtaccccgcgtgcgggatctgatcaggagacacatcacacgtgctttacacctgtgcttgtgtttaaaaattgttacagcttccccgaaccaagtggtcttggttttcactttttatcacactgtcaat

SEQ ID NO: 1061 - DNA, 646 bp, Artificial sequence
  Synthesized
gacgaaagtgctatcatgcctccccgattatgtgatgttttctgccctgctgggcggagcattctcgggttgatataccttgaatccttcatccttggacctcccggtcccccggtctaagccacttggaatatgacagggttattttccaaaattcttatttccactttcatgagttcttttcatgaaaagggtatgtgctgccccttccttcttggagaatccgcgtggcggtctttccgtctctcgaaaaacgtggatgcagcatgctggaaacggtgaagaaagtagttctctgtggaaacttagaacagacatcgaaacagctgtagcgacctcacagtagcagcggaaccccctcctggcgacaggagcctctgcggccaaaagccccgtggataagatccactgctgtgagcggtgcaaccccagcaccctggttcgatggttgttctctgtggaatcagagaatggctttcctaagccctccagtagagaagccaagaatgtcctgaaggtaccccgcgtgcgggatctgatcaggagacacatcacacgtgctttacacctgtgcttgtgtttaaaaattgttacagcttccccgaaccaagtggtcttggttttcactttttatcacactgtcaat

SEQ ID NO: 1062 - DNA, 742 bp, Enterovirus 68
ttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagattgttaccatatagctattggattggccatccggtgagcaatagagcgattatttactcttttgttggatttgtgccattggatcacaccacaatcatcacactaaagtatattttactattaaatacagcaaa

SEQ ID NO: 1063 - DNA, 710 bp, Enterovirus 68
ttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagattgttaccatatagctattggattggccatccggtgaataatagagcgataatatatttgtttgttggattcgtgccacttagtctgaaagttttgagaaca

SEQ ID NO: 1064 - DNA, 733 bp, Enterovirus 68
ttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagattgttaccatatagctattggattggccatccggtgaccaatagagctattatatatctctttgttggagcttgcttgttctttttgcagaagctcagaataaacgctcaactttggccgccacc

SEQ ID NO: 1065 - DNA, 1064 bp, Theiler's Murine Encephalomyocarditis virus
ttgaaagggggcccgggggatctaccccgcggtaactggtgacagttgtcgcggacggagatcatcccccggttaccccctttcgacgcgggtactgcgatagtgccaccccagtctttcctactcccgactcccgaccctaacccaggttcctcggaacaggaacaccaatttactcatcccctggatgctgactaatcagaggaacgtcagcattttccggcccaggctaagagaagtagataagttagaatccaaattgatttatcatccccttgacgaattcgcgttggaaaaacacctctcacttgcccctcttcacacccattaatttaattcggcctctgtgttgagccccttgttgaagtgtttccctccatcgcgacgtggttggagatctaagtcaaccgactccgacgaaactaccatcatgcctccccgattatgtgatgctttctgccctgctgggtggagcaccctcgggttgagaaaaccttcttcctttttccttggactccggtcccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagaaagcagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacactctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttttcactttttatcacactgtcaat

SEQ ID NO: 1066 - DNA, 410 bp, Artificial sequence
  Synthesized
gaaacccgtatacaccggaccttttctcccctccctctccacttacctttttcccctcttcggcatgaaacaaggattattcaagtggaaacgcgatttaatatgcggctggccaccgcggaataacggcaattgtgtatctgctggaagccaagcctgcctagccgatagcccttgaccgggtgtgtaggatagcccaggaaccagcaatacgcgacaggttatggtagagtagatacctagccaggggcaatgggactgcattgcatatccctaatgaaccattgagatttctctggtcattacccggtgatggttactagaggggggcctctagtactagatctatactgcctgatagggtcgcggctggccgaccatgacctgtatagtcagttgatttgagcaat

SEQ ID NO: 1067 - DNA, 1049 bp, Theilovirus
ttcaaaggggggccccggggtcttcgccgcggacacgcgttagtgtgttcgcggtgaagatcaccccgggaaaccccctttggacgcgggacctgcgacagtgccatcccccgtctctcctattccaactacccgaccctaacccagggtccaggacactggatcaatacaagtcatcccctgaatgctggctaatcagaggaaagtcagcattttccggcccaggctaagagaaacacaataagttagaatctaaattaatcaccttgacgaattcgcaaagataagtcctccctcccttgccgctcgatcacacccagaactaacaattcggcctctcgtgacgagccccttggtgaaaggacctctttcaacgcgacgtggttggagattaaaaccgactccgacgaaagtgctatcatgcctccccgattatgtgatgttttctgccctgctgggcggagcattctcgggttgatataccttgaatccttcatccttggacctcccggtcccccggtctaagccacttggaatatgacagggttattttccaaaattcttatttccactttcatgagttcttttcatgaaaagggtatgtgctgccccttccttcttggagaatccgcgtggcggtctttccgtctctcgaaaaacgtggatgcagcatgctggaaacggtgaagaaagtagttctctgtggaaacttagaacagacatcgaaacagctgtagcgacctcacagtagcagcggaaccccctcctggcgacaggagcctctgcggccaaaagccccgtggataagatccactgctgtgagcggtgcaaccccagcaccctggttcgatggttgttctctgtggaatcagagaatggctttcctaagccctccagtagagaagccaagaatgtcctgaaggtaccccgcgtgcgggatctgatcagaagaccaattgccagtgctatacactggtactttggtttaaaaattgtcacagcttctccaaaccaagtggtcttggttttctatctttaataattggttc

SEQ ID NO: 1068 - DNA, 419 bp, Artificial sequence
  Synthesized
gggttttacgaaacccgtatacaccagaccttttctcccctccccctccacctaccttttccccctctttggaccgaaacaaggacacgtaagtggaaacgcgattttatatgtggttggccaccacggaataacggcaattgtctacatgtgggaagtgcaacctccctagccgataacccctgaccgggtgtgtaggataggaaaggtgcccactgtgggcgacaggttatggtagagtggatacctagccaggggcaatgggactgctttgcatatccctaatgaagtattgagatttctctgctcattacccggtgatggttgtgtggggggggccccatacactagatccatactgcctgatagggtcgcggctggccgaccataacctgtatagtcagttgaattcagccaag

SEQ ID NO: 1069 - DNA, 331 bp, Artificial sequence
  Synthesized
gcaagtggaaacgcgattttatatgtggctggccaccacggaataacggcaattgtttacatgtgggaagtgcaacctccctagccgatagcccttgaccgggtgtgtaggataggaaaggtgcccactgtgagcgacaggttatggtagagtggatacctagccaggggcaatgggactgctttgcatatccctaatgaagcatcgagagttctctgctcattacccggtgacggttgtgtggggggggccccacacactagatccatactgcctgatagggtcgcggctggccgaccataacctgtatagtcagttgattttaaccaag

SEQ ID NO: 1070 - DNA, 305 bp, Artificial sequence
  Synthesized
gtggctggccaccacggaataacggcaattgtttgtatgtgggaggtcaagcctgcctagccgataacctttgaccgggtgtgtaggatagaacaggaacccactacaggcgacaggttatggtagagtggatacctagccaggggcaatgggactgcgttgcatatccctaatgagccatcgagatttctctggccattacccggtgatggttgtgtggggggggccccacacactagatccatactgcctgatagggtcgcggctggccgaccataacctgtatagtcagttgactttgaatc

SEQ ID NO: 1071 - DNA, 742 bp, Coxsackievirus
ttaaaacagcctgtgggttgatcccacccacagggcccattgggcgctagcactctggtatcacggtacctttgtgcgcctgttttataccccctcccccaactgtaacttagaagtaacacacaccgatcaacagtcagcgtggcacaccagccacgttttgatcaagcacttctgttaccccggactgagtatcaatagactgctcacgcggttgaaggagaaagcgttcgttatccggccaactacttcgaaaaacctagtaacaccgtggaagttgcagagtgtttcgctcagcactaccccagtgtagatcaggtcgatgagtcaccgcattccccacgggcgaccgtggcggtggctgcgttggcggcctgcccatggggaaacccatgggacgctctaatacagacatggtgcgaagagtctattgagctagttggtagtcctccggcccctgaatgcggctaatcctaactgcggagcacacaccctcaagccagagggcagtgtgtcgtaacgggcaactctgcagcggaaccgactactttgggtgtccgtgtttcattttattcctatactggctgcttatggtgacaattgagagattgttaccatatagctattggattggccatccggtgaccaatagagctattatatatctctttgttgggtttataccacttagcttgaaagaggttaaaacattacaattcattgttaagttgaatacagcaaa

SEQ ID NO: 1072 - DNA, 641 bp, Echovirus
actgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacactcaactacgttttattgctgaatagtgcaag

SEQ ID NO: 1073 - DNA, 652 bp, Salmonid alphavirus
gacgaaactaccatcatgcctccccgattatgtgatgctttctgccctgctgggtggagcatcctcgggttgagaaaaccttcttcctttttccttggaccccggtcccccggtctaagccgcttggaataagacagggttatcttcacctcttccttcttctacttcatagtgttctatactatgaaagggtatgtgtcgccccttccttctttggagaacacgcgcggcggtctttccgtctctcgaaaagcgcgtgtgcgacatgcagagaaccgtgaagaaagcagtttgcggactagctttagtgcccacaagaaaacagctgtagcgaccacacaaaggcagcggaccccccctcctggcaacaggagcctctgcggccaaaagccacgtggataagatccacctttgtgtgcggcacaaccccagtgccctggtttcttggtgacacttcagtgaaaacgcaaatggcgatctgaagcgcctctgtaggaaagccaagaatgtccaggaggtaccccttccctcgggaagggatctgacctggagacacatcacatgtgctttacacctgtgcttgtgtttaaaaattgtcacagctttcccaaaccaagtggtcttggttttcactctttaaactgatttcact

SEQ ID NO: 1074 - DNA, 552 bp, Salmonid alphavirus
cccggtcccccggtctaagccgcttggaataagacagggttatcttcacctcttccttcttctacttcatagtgttctatactatgaaagggtatgtgtcgccccttccttctttggagaacacgcgcggcggtctttccgtctctcgaaaagcgcgtgtgcgacatgcagagaaccgtgaagaaagcagtttgcggactagctttagtgcccacaagaaaacagctgtagcgaccacacaaaggcagcggaccccccctcctggcaacaggagcctctgcggccaaaagccacgtggataagatccacctttgtgtgcggcacaaccccagtgccctggtttcttggtgacacttcagtgaaaacgcaaatggcgatctgaagcgcctctgtaggaaagccaagaatgtccaggaggtaccccttccctcgggaagggatctgacctggagacacatcacatgtgctttacacctgtgcttgtgtttaaaaattgtcacagctttcccaaaccaagtggtcttggttttcactctttaaactgatttcact

SEQ ID NO: 1075 - DNA, 1473 bp, Echovirus
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacactcaactacgttttattgctgaatagtgcaagtctttaagaaggagataaaaaatgactgccctgaccgaaggtgctaagctgtttgagaaggagattccgtacatcaccgagctggaaggggacgtcgaaggaatgaagttcatcatcaagggagaaggaaccggggacgctacgactggaaccattaaggccaagtatatctgtaccactggagatctgccagtgccttgggccacccttgtgtcaaccctctcgtatggagtgcagtgttttgctaagtaccctagccacattaaggacttcttcaaatccgccatgccggaaggttatacccaagagcgcaccatttcttttgagggagatggagtgtacaagacccgcgcgatggtcacctatgagaggggatctatctacaaccgggtgactctgactggagaaaactttaagaaggacgggcatattcttcggaagaatgtcgccttccagtgccctcccagcatcctttacattctccccgacactgtgaacaacggaatccgcgtggagttcaatcaagcctacgacatcgagggggtgacggagaagctggtgaccaagtgtagccagatgaatcggccactggccggttcagcggctgtccacattccgcgctaccatcatatcacttatcacactaagctctccaaagaccgcgatgagaggagagatcacatgtgcctggtggaagtggtcaaggccgtcgatctcgatacctatcagtaa

SEQ ID NO: 1076 - DNA, 709 bp, Echovirus
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaaca

SEQ ID NO: 1077 - DNA, 686 bp, Echovirus
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccac

SEQ ID NO: 1078 - DNA, 656 bp, Echovirus
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcga

SEQ ID NO: 1079 - DNA, 741 bp, Artificial sequence
  Synthesized
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacattacaattcattgttaagttgaatacagcaaa

SEQ ID NO: 1080 - DNA, 741 bp, Artificial sequence
  Synthesized
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagaggttaaaacattacaattcattgttaagttgaatacagcaaa

SEQ ID NO: 1081 - DNA, 741 bp, Artificial sequence
  Synthesized
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttgggtttataccacttagcttgaaagaggttaaaacattacaattcattgttaagttgaatacagcaaa

SEQ ID NO: 1082 - DNA, 649 bp, Theiler's Murine Encephalomyocarditis virus; identical to SEQ ID NO: 1058

SEQ ID NO: 1083 - DNA, 1064 bp, Artificial sequence; identical to SEQ ID NO: 1059
  Synthesized

SEQ ID NO: 1084 - DNA, 1051 bp, Artificial sequence; identical to SEQ ID NO: 1060
  Synthesized

SEQ ID NO: 1085 - DNA, 646 bp, Artificial sequence; identical to SEQ ID NO: 1061
  Synthesized

SEQ ID NO: 1086 - DNA, 741 bp, Artificial sequence
  Synthesized
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgagcaatagagcgattatttactcttttgttggatttgtgccattggatcacaccacaatcatcacactaaagtatattttactattaaatacagcaaa

SEQ ID NO: 1087 - DNA, 1064 bp, Theiler's Murine Encephalomyocarditis virus
ttgaaagggggcccgggggatctcccccgcggtaactggtgacagttgtcgcggacggagatcatcccccggttaccccctttcgacgcgggtactgcgatagtgccaccccagtctttcctactcccgactcccgaccctaacccaggttcctcggaacaggaacaccaatttactcatcccctggatgctgactaatcagaggaacgtcagcattttccggcccaggctaagagaagtagataagttagaatccaaattgatttatcatccccttgacgaattcgcgttggaaaaacacctctcacttgcccctcttcacacccattaatttaattcggcctctgtgttgagccccttgttgaagtgtttccctccatcgcgacgtggttggagatctaagtcaaccgactccgacgaaactaccatcatgcctccccgattatgtgatgctttctgccctgctgggtggagcaccctcgggttgagaaaaccttcttcctttttccttggactccggtcccccggtctaagccgctcggaatatgacagggttattttcacctcttcttttctactccacagtgttctatactgtggaagggtatgtgttgccccttccttcttggagaacgtgcgcggcggtctttccgtctctcgacaagcgcgcgtgcaacatacagagtaacgcgaagaaagcagttctcggtctagctctagtgcccacaagaaaacagctgtagcgaccacacaaaggcagcggaacccccctcctggtaacaggagcctctgcggccaaaagccacgtggataagatccacctttgtgtgcggtgcaaccccagcaccctggtttcttggtgacactctagtgaacccctgaatggcaatctcaagcgcctctgtagggaagccaagaatgtccaggaggtaccccttcctctcggaagggatctgacctggagacacatcacacgtgctttacacctgtgcttgtgtttaaaaattgttacagcttccccgaaccaagtggtcttggttttcactttttatcacactgtcaat

SEQ ID NO: 1088 - DNA, 741 bp, Artificial sequence; identical to SEQ ID NO: 1056
  Synthesized

SEQ ID NO: 1089 - DNA, 742 bp, Artificial sequence
  Synthesized
ttaaaacagcctgtgggttgtacccacccacagggcccactgggcgctagcactctggtactacggtacctttgtgtgcctgttttatacccctccccctactgaaacttagaagcaattcataccgatcaatagtgggcgtggcacaccagccgtgtctagatcaagcacttctgtttccccgggaccgagtatcaatagactgctcacgcggttgaaggagaaagcgttcgttacccggccatctacttcgagaagcctagtaacaccatgaaagttgcagagcgtttcgctcagcacttcccccgtgtagatcaggccgatgagtcactgcaaccctcacgggcgaccgtggcagtggctgcgttggcggcctgcccatgggattacccatgggacgctctaatacagacatggtgtgaagaacctattgagctagttggtagtcctccggcccctgaatgcggctaatcctaactgcggagcatacaccctcaatccagggggcagtgtgtcgtaacgggcaactctgcagcggaaccgactactttgggtgtccgtgtttccttttattcttattatggctgcttatggtgacaattgagagattgttgccatatagctattggattggccatccggtgagcaatagagcgattatttactcttttgttggatttgtgccattggatcacaccacaatcatcacactaaagtatattttactattaaatacagcaaa

SEQ ID NO: 1090 - DNA, 668 bp, Artificial sequence
  Synthesized
gttttacacccccttaccctaatagcaacttagaaggctcaatgcatctacgaccaatagcaggcgcgacggcaccaagtcgtgtctcggtcaagcactcctgtttccccggaccgagtatcaatagactgctcacgcggttgaaggagaaaacgttcgttatccggctaactacttcgaaaaacctagtaacaccatgaaagttgcggagtgtttcactcagcacttccccagtgtagatcaggtcgatgagtcaccgcattcctcacgggcgaccgtggcggtggctgcgctggcggcctgcctatggggtgacccataggacgctctaatacagacatggtgcgaagagtctattgagctagttagtagtcctccggcccctgaatgcggataatcctaactgtggagcagatacccacgaaccagtgggcagtctgtcgtaacgggcaactccgcagcggaaccgactactttgggtgtccgtgtttccttttattccaaatctggctgcttatggtgacaattgagagattgttgccatatagctattggattggccatccggtgaataatagagcgataatatatttgtttgttggattcgtgccacttagtctgaaagttttgagaacactcaactacgttttattgctgaatagtgcaag

SEQ ID NO: 1091 - DNA, 669 bp, Artificial sequence
  Synthesized
gttttacacccccttaccctaatagcaacttagaaggctcaatgcatctacgaccaatagcaggcgcgacggcaccaagtcgtgtctcggtcaagcacttctgtttccccgggaccgagtatcaatagactgctcacgcggttgaaggagaaagcgttcgttacccggccatctacttcgagaagcctagtaacaccatgaaagttgcagagcgtttcgctcagcacttcccccgtgtagatcaggccgatgagtcactgcaaccctcacgggcgaccgtggcagtggctgcgttggcggcctgcccatgggattacccatgggacgctctaatacagacatggtgtgaagaacctattgagctagttggtagtcctccggcccctgaatgcggctaatcctaactgcggagcatacaccctcaatccagggggcagtgtgtcgtaacgggcaactctgcagcggaaccgactactttgggtgtccgtgtttccttttattcttattatggctgcttatggtgacaattgagagattgttgccatatagctattggattggccatccggtgaataatagagcgataatatatttgtttgttggattcgtgccacttagtctgaaagttttgagaacactcaactacgttttattgctgaatagtgcaag

SEQ ID NO: 1092 - DNA, 1055 bp, Theilovirus
ttcaaaggggggccccggggtcttcgccgcggacacgcgttagtgtgttcgcggtgaagatcaccccgggaaaccccctttggacgcgggacctgcgacagtgccatcccccgtctctcctattccaactacccgaccctaacccagggtccaggacactggatcaatacaagtcatcccctgaatgctggctaatcagaggaaagtcagcattttccggcccaggctaagagaaacacaataagttagaatctaaattaatcaccttgacgaattcgcaaagataagtcctccctcccttgccgctcgatcacacccagaactaacaattcggcctctcgtgacgagccccttggtgaaaggacctctttcaacgcgacgtggttggagattaaaaccgactccgacgaaagtgctatcatgcctccccgattatgtgatgttttctgccctgctgggcggagcattctcgggttgatataccttgaatccttcatccttggacctcccggtcccccggtctaagccacttggaatatgacagggttattttccaaaattcttatttccactttcatgagttcttttcatgaaaagggtatgtgctgccccttccttcttggagaatccgcgtggcggtctttccgtctctcgaaaaacgtggatgcagcatgctggaaacggtgaagaaagtagttctctgtggaaacttagaacagacatcgaaacagctgtagcgacctcacagtagcagcggaaccccctcctggcgacaggagcctctgcggccaaaagccccgtggataagatccactgctgtgagcggtgcaaccccagcaccctggttcgatggttgttctctgtggaatcagagaatggctttcctaagccctccagtagagaagccaagaatgtcctgaaggtaccccgcgtgcgggatctgatcagaagaccaattgccagtgctatacactggtactttggtttaaaaattgtcacagcttctccaaaccaagtggtcttggttttctatctttaataattggttcatgatg

SEQ ID NO: 1093 - DNA, 742 bp, Poliovirus
ttaaaacagctctggggttgtacccaccccagaggcccacgtggcggctagtactccggtattgcggtacccttgtacgcctgttttatactcccttcccgtaacttagacgcacaaaaccaagttcaatagaagggggtacaaaccagtaccaccacgaacaagcacttctgtttccccggtgatgtcgtatagactgcttgcgtggttgaaagcgacggatccgttatccgcttatgtacttcgagaagcccagtaccacctcggaatcttcgatgcgttgcgctcagcactcaaccccagagtgtagcttaggctgatgagtctggacatccctcaccggtgacggtggtccaggctgcgttggcggcctacctatggctaacgccatgggacgctagttgtgaacaaggtgtgaatagcctattgagctacataagaatcctccggcccctgaatgcggctaatcccaacctcggagcaggtggtcacaaaccagtgattggcctgtcgtaacgcgcaagtccgtggcggaaccgactactttgggtgtccgtgtttccttttattttattgtggctgcttatggtgacaatcacagattgttatcataaagcgaattggattggccatccggtgaaagtgagactcattatctatctgtttgctggatccgctccattgagtgtgtttactctaagtacaatttcaacagttatttcaatcagacaattgtatcata

SEQ ID NO: 1094 - DNA, 669 bp, Artificial sequence; identical to SEQ ID NO: 1055
  Synthesized

SEQ ID NO: 1095 - DNA, 181 bp, Xenopus tropicalis
ccctttgcctgccaatcacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtc

SEQ ID NO: 1096 - DNA, 652 bp, Salmonid alphavirus; identical to SEQ ID NO: 1073

SEQ ID NO: 1097 - protein, 610 aa, Artificial sequence; identical to SEQ ID NO: 600
  Synthesized

SEQ ID NO: 1098 - protein, 610 aa, Artificial sequence
  Synthesized
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSSRHVNVKGRYVRCQDCPYKKDRKTKRSCNACAKPICMEHAKFLCENCAELDSSL

SEQ ID NO: 1099 - DNA, 1775 bp, Artificial sequence
  Synthesized
tgtatactctatattatactctatgttatactctgtaatcctactcaataaacgtgtcacgcctgtgaaaccgtactaagtctcccgtgtcttcttatcaccatcaggtgacatcctcgcccaggctgtcaatcatgccggtatcgattccagtagcaccggccccacgctgacaacccactcttgcagcgttagcagcgcccctcttaacaagccgacccccaccagcgtcgcggttactaacactcctctccccggggcatccgctactcccgagctcgaattcgtttatcggccaccgaggccaagatctggccgccatatactgagtcattagggactttccaatgggttttgcccagtacataaggtcaataggggtgaatcaacaggaaagtcccattggagccaagtacactgagtcaatagggactttccattgggttttgcccagtacaaaaggtcaatagggggtgagtcaatgggtttttcccattattggcacgtacataaggtcaataggggtgagtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtagggaccggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagatggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcag

SEQ ID NO: 1100 - DNA, 1536 bp, Hepatitis B virus
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagctggactggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacttgcccaaggtcttgcataagaggactcttggactttcagcaatgtcatc

SEQ ID NO: 1101 - DNA, 1923 bp, Hepatitis B virus; identical to SEQ ID NO: 843

SEQ ID NO: 1102 - DNA, 1927 bp, Hepatitis B virus
ctgttctcatcacatcatatcaaggttatataccatcaatattgccacagatgttacttagccttttaatatttctctaatttagtgtatatgcaatgatagttctctgatttctgagattgagtttctcatgtgtaatgattatttagagtttctctttcatctgttcaaatttttgtctagttttattttttactgatttgtaagacttctttttataatctgcatattacaattctctttactggggtgttgcaaatattttctgtcattctatggcctgacttttcttaatggttttttaattttaaaaataagtcttaatattcatgcaatctaattaacaatcttttctttgtggttaggactttgagtcataagaaatttttctctacactgaagtcatgatggcatgcttctatattattttctaaaagatttaaagttttgccttctccatttagacttataattcactggaatttttttgtgtgtatggtatgacatatgggttcccttttattttttacatataaatatatttccctgtttttctaaaaaagaaaaagatcatcattttcccattgtaaaatgccatatttttttcataggtcacttacatatatcaatgggtctgtttctgagctctactctattttatcagcctcactgtctatccccacacatctcatgctttgctctaaatcttgatatttagtggaacattctttcccattttgttctacaagaatatttttgttattgtctttgggctttctatatacattttgaaatgaggttgacaagttaataacaggcctattgattggaaagtttgtcaacgaattgtgggtcttttggggtttgctgccccttttacgcaatgtggatatcctgctttaatgcctttatatgcatgtatacaagcaaaacaggcttttactttctcgccaacttacaaggcctttctcagtaaacagtatatgaccctttaccccgttgctcggcaacggcctggtctgtgccaagtgtttgctgacgcaacccccactggttggggcttggccataggccatcagcgcatgcgtggaacctttgtgtctcctctgccgatccatactgcggaactcctagccgcttgttttgctcgcagcaggtctggagcaaacctcatcgggaccgacaattctgtcgtactctcccgcaagtatacatcgtttccatggctgctaggctgtgctgccaactggatcctgcgcgggacgtcctttgtttacgtcccgtcggcgctgaatcccgcggacgacccctcccggggccgcttggggctctaccgcccgcttctccgtctgccgtaccgtccgaccacggggcgcacctctctttacgcggactccccgtctgtgccttctcatctgccggaccgtgtgcacttcgcttcacctctgcacgtcgcatggaggccaccgtgaacgcccaccggaacctgcccaaggtcttgcataagaggactcttggactttcagcaatgtcatctcagtggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 1103 - DNA, 14 bp, Bombyx mori
atgaggcagggtat

SEQ ID NO: 1104 - DNA, 14 bp, Bombyx mori
ataccctgcctcat

SEQ ID NO: 1105 - DNA, 10 bp, Bombyx mori
ggcagggtat

SEQ ID NO: 1106 - DNA, 10 bp, Bombyx mori
ataccctgcc

SEQ ID NO: 1107 - DNA, 10 bp, Bombyx mori
taaaatttta

SEQ ID NO: 1108 - DNA, 12 bp, Bombyx mori
attttataaaat

SEQ ID NO: 1109 - DNA, 10 bp, Bombyx mori
tcataccctg

SEQ ID NO: 1110 - DNA, 13 bp, Bombyx mori
taaataataataa

What is claimed is:

1. A polynucleotide comprising an EF1 promoter comprising SEQ ID NO: 905, operably linked to a heterologous nucleic acid sequence to be expressed.

2. The polynucleotide of claim 1, further comprising an intron comprising a sequence 95% identical to a sequence selected from SEQ ID NOS: 958-997.

3. The polynucleotide of claim 1, wherein the polynucleotide further comprises a segment encoding a selectable marker.

4. The polynucleotide of claim 3, wherein the selectable marker is one of the following: glutamine synthase, dihydrofolate reductase, puromycin-N acetyl transferase, blasticidin-S deaminase, hygromycin phosphotransferase, aminoglycoside phosphotransferase, nourseothircin N-acetyl transferase, or a protein that binds to zeocin.

5. The polynucleotide of claim 4, wherein the segment encoding the selectable marker is operably linked to a promoter comprising a sequence selected from SEQ ID NOS: 937-948.

6. The polynucleotide of claim 1, wherein the polynucleotide further comprises a second promoter.

7. The polynucleotide of claim 6, wherein the promoter is selected from one of the following: an EF1 a promoter, a CMV promoter, an EEF2 promoter, an SV40 promoter, a PGK promoter, an actin promoter, a GAPDH promoter, an ILV5 promoter or an HSV-TK promoter.

8. The polynucleotide of claim 6, wherein the promoter comprises a sequence selected from SEQ ID NO: 892-936.

9. The polynucleotide of claim 1 further comprising an IRES.

10. The polynucleotide of claim 9, wherein the IRES is at least 95% identical to a sequence selected from SEQ ID NO: 1050-1094.

11. The polynucleotide of claim 1, further comprising a sequence that is at least 90% identical to a sequence selected from SEQ ID NO: 998-1049.

12. The polynucleotide of claim 1, further comprising a sequence that is at least 90% identical to a sequence selected from SEQ ID NO: 820-858.

13. The polynucleotide of claim 1, further comprising a sequence that is at least 90% identical to a sequence selected from SEQ ID NO: 751-819.

14. The polynucleotide of claim 1, further comprising a sequence that is at least 90% identical to a sequence selected from SEQ ID NO: 719-749.

15. The polynucleotide of claim 1, wherein the polynucleotide further comprises an insulator.

16. The polynucleotide of claim 15, wherein the insulator is at least 95% identical to a sequence selected from one of SEQ ID NOS: 859-865.

17. The polynucleotide of claim 1, wherein the polynucleotide further comprises a pair of transposon ends.

18. A vector for expression of a gene in a mammalian cell comprising the polynucleotide of claim 1.

19. The vector of claim 18 wherein the mammalian cell is a rodent cell.

20. An isolated cell whose genome comprises the polynucleotide of claim 1.

* * * * *